United States Patent 7,432,049 (COMPOSITIONS AND METHODS RELATING TO OSTEOARTHRITIS) - sequence listing, part 6

SEQ ID NO: 33586 - DNA, 376 bp, Homo sapiens
ctcgcaggggaatttgcactattacacttgaaggttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtgga

SEQ ID NO: 33587 - DNA, 273 bp, Homo sapiens
  misc_feature 6: n = A,T,C or G
caaacnaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgtttgatgttttg

SEQ ID NO: 33588 - DNA, 412 bp, Homo sapiens
  misc_feature 43: n = A,T,C or G
agccagaccactccctgctccgcaccagcccctccagctgacnccctgttggaccagtacatcagagagcaacgcgagaaggattctgtcatgtcggccaatgggaaaccagatcctgacactgttccggactcgtagccagcctgtttagccagccctgcgcataaatacactccgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggctttgtccttagttttcccaacttgggacgtgataggagcaaagtctctccattctccaggtccaaggcagagatcctgaaaaga

SEQ ID NO: 33589 - DNA, 179 bp, Homo sapiens
acagatggacacactgaaatacagagaagttaggtaatacatgcaaggtcagtcagccagtaaaatgtggacttggagcctcgtaatctgatttcacagcctgtactcttaattgttttgttatgtttgctggaaaacattgcttcttaatttccatatgcatattctaaggattcgat

SEQ ID NO: 33590 - DNA, 321 bp, Homo sapiens
  misc_feature 2, 22, 36, 43, 85: n = A,T,C or G
tngggaccttttaggggtaaantgaaaaaattttanttggtanttttaaaagtagtttctaagtgttagccaagacctgacctantaattcccagtttctgttttctatggacagaccctgataaactggagacccctaaagcaggaataccccaaattatagtgtcaggattttagctgtacccagaggccctttatgtgctacacataatttgtataaaattttatatgtgcagattgggtacataaacagttctccatttttctaagggaatgcaataaatgtagcatcgtgaataaatataacttttataatccgca

SEQ ID NO: 33591 - DNA, 278 bp, Homo sapiens
  misc_feature 27: n = A,T,C or G
atcctcaagtggcataaaaatgtagtnagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtggaataaaactgtaaatttgcataactggatgtacttagataatgtgaaataaacattaaagacaaggtctattttt

SEQ ID NO: 33592 - DNA, 266 bp, Homo sapiens
  misc_feature 192, 233, 249: n = A,T,C or G
cagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttanaattcttctttctttcttaagccctttgctccggaggaagngctccagcttcagctnaactcacagctgctcca

SEQ ID NO: 33593 - DNA, 291 bp, Homo sapiens
  misc_feature 12, 22: n = A,T,C or G
tgggcccgggcntggtgggganggtgattggatcatgggggcagtttcttatgctttaacaacatcccccttggtgttgtcacattgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaaccg

SEQ ID NO: 33594 - DNA, 143 bp, Homo sapiens
catcttccctcagttccataaaaccttcattacacataaagatacaccgtgggggtcagtgaatctgcttgcctttcctgaaagtttctggggcttaagattccagactctgattcattaaactatagtcacccgtgtcctac

SEQ ID NO: 33595 - DNA, 390 bp, Homo sapiens
  misc_feature 8, 11, 34, 41, 53, 385, 387: n = A,T,C or G
cttgggtntcncccgggttaaaaaccgccagagnggaggangggaaatgaccnaggagtcgaaagggagaagataagtgccctctgtgtacccaaaaaggaatgtacctgtttatagagacttcaaatcagcagaaaattcaaatagttataacttttctttataatccatcatgaaaaagagtaacgacaaataagagtgcagtgggtgcagtcatggctcactgcagcgtctgcctcctggactcaaagaatcctcctacctcagcctcccaagtagctaggaccacagagttgtgctctcctgcagcgttttgcggacggctggctatcttacccagaatcaatcacactgggacactgaaaaaaaaaaaaagggaaaaaanancgg

SEQ ID NO: 33596 - DNA, 384 bp, Homo sapiens
  misc_feature 8, 9, 27, 29, 34, 39, 260: n = A,T,C or G
tccggccnntttaatgggccgggggancnagagncctcnagtggtgggaagagatccctgcagaaccccaccaacccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctttgggnaagtggtcagcgcatcctgcagggcttctcctcctctgtcttttggagaaccagggctcttctcaggggctctagggactgccaggctgtttcagccaggaaggccaaaatcaagagtgagatg

SEQ ID NO: 33597 - DNA, 386 bp, Homo sapiens
  misc_feature 2, 22, 128, 362: n = A,T,C or G
gnggtttttttactttctaccngtcaaatgactgtgccaaaaacccttttacctgggttgcatggaaatcagccaagttttataatcccttaaatcttaatgttcctcaaagcttggattaaataccntatggatgttacctctcttgccccaaattatcttgatacattcaaatttgtctggttaaaaaataggtggtagatattgaggccaagaatattacaaaatacatgaagcttcatgcacttaaagaagtatttttagaataagaatttgcatacttacctagtgaaacttttctagaattatttttcactctaagcatgtatgtttctctttgattatttgcatggtaatggttnaataagctactagcaaaataaaac

SEQ ID NO: 33598 - DNA, 392 bp, Homo sapiens
  misc_feature 3, 18, 35, 37, 48, 97: n = A,T,C or G
ccngggaaatttcggccnttatggcccggggcctnanattacttatcnacagtttgtcaggaaatagatctactccatacagtagctccagaaaccncactgatggaatttctgacagtgtatatctgtacaccctggaacattagtccttcacggtgaccaccacatggaaataaagagctagaaggtcttctgttggccgttaaatatttcagccatgaaatgacacccaggtcattcaggcactcacaacctagtaaccagaactagttaccttaccctactggtaagtgtccgggacatgtgggaagcacaggttgttttggtgaactgtaaatgtgtctgtcacatattgtacttcatcaagaaatatgcgtagcctttaaacctat

SEQ ID NO: 33599 - DNA, 500 bp, Homo sapiens
  misc_feature 15, 28, 35, 52, 89, 103, 130, 159, 180, 181: n = A,T,C or G
ctacccctggggaanctaggccatctantgggccngggaaacgtccaagtanggaacctttccttacgccctgcctgtccaacgggaanggcctcccagaaanttcaccctacccacctgcaaagaaacnagcatttgccctattctgggaccgaagcnagcctggcaaccctcaagaannggccctgctcatcccagggcctccaatgacgtggagatcccgggcagagggcaatagcaggttcacgtacacctgccctgaaggatggctgcacgaaacataccggtaagtggggcaagactgttatcgagtaccggtcacagaagacctcacgcctccccatcattgacattgcacccatggacataggagggcccgagcaggaattcgggtgtggacatagggccggtctgcttcttgtaaaaacctgaacccagaaacaacacaatccgttgcaaacccaaaggacccaagtactttccaatctcagtcactctag

SEQ ID NO: 33600 - DNA, 481 bp, Homo sapiens
  misc_feature 423, 479, 480: n = A,T,C or G
gtagcctgagataggcatgtgccacccacaactggctaattatttttttgtgcttttagtagagaaggggtttcatcatgttggccaggctggtctcgaactcctgacctcaggtaatctgcctgcctcggcctcccaaagtgctgggattacagacatgaaccactgtgcctggcctaacaaaggaatcctgaacttaaacttgacacttgaccaactggacttaatagacatctacatgcacccatcaccatagaatgtatattctcatcttcacaaggaattaccccaagatcaaccacatgcttggtcataaagcaagtctcaataaactttttaaaaaatcaaaattataccatccatactcttggacaacagtgaaataaaaatagaaatcaataccaaaaagatttctcaaagccncacaattatatgcaattaatttttctgaatgacttttggataacatgaatcaaggnna

SEQ ID NO: 33601 - DNA, 107 bp, Homo sapiens
  misc_feature 14: n = A,T,C or G
aaagtaggattacnaagcatgccgccgacgatgccccagaatccagaactttgtctatcactctccccaacaaccctagatgtgaaaacagaataaacttcacccag

SEQ ID NO: 33602 - DNA, 115 bp, Homo sapiens
  misc_feature 11, 74: n = A,T,C or G
atagatatatncttaaaatatttggttttaaatcacaagaatatgtattctttaataaagataatttatgatcntggtataattaattgaaatttattaaaatctgtttttaccg

SEQ ID NO: 33603 - DNA, 365 bp, Homo sapiens
  misc_feature 16: n = A,T,C or G
cccgggaattcggccnttatggcccggggcctcttccggggacgttgtctgcaggcacctcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggtccgtgctgtaagacctaaagttcttatgagattgtccaaaacaaagaaacatgtcagcagggcctatggtggttccatgtgtgctaaatgtgttcgtgacaggatcaagcgtgctttccttatcgaggagcaga

SEQ ID NO: 33604 - DNA, 275 bp, Homo sapiens
  misc_feature 13, 15, 34, 269: n = A,T,C or G
atggcccggggancnaaggtaaaaattaagaatnagtgagaaatggaatttgcaaaagtgccctgccagataatgttagaactggaccagaaaataggagttggtataaaactagaccagcgagcttttttttccttcaagatgcagttcagtttattgcttttgtaaattagagattgtgtttcttgatctttattaaagtagaatacaatgttaacctacttcaaattttaaaaaatatacacacatgtatatgtatgtgtgtgtgnatatac

SEQ ID NO: 33605 - DNA, 351 bp, Homo sapiens
  misc_feature 6, 9, 48: n = A,T,C or G
tgtganganctacagaactttgccgaaacgcctacgcccatggtttanggatacaatgctgccctataatcgctacttcaggaagccgccgagggacccaaatgagactgagggaagaaaaaaaatctctttttttctggaggctggcaccctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtggattgttccataataaacttctggtgtgatact

SEQ ID NO: 33606 - DNA, 469 bp, Homo sapiens
  misc_feature 9, 28: n = A,T,C or G
tccggccantttatgggcccggggggantgaagggcagagaattttacatgcggcaaacgggcccccatcagtgccaccctggtgatgacaccgcccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaaga

SEQ ID NO: 33607 - DNA, 405 bp, Homo sapiens
  misc_feature 2, 7, 25, 32, 36, 50, 51, 57, 60, 64, 72, 365: n = A,T,C or G
cntggantacttgccccttccttantttttantacnaaaaataaatcccnntttaantantccnaaaatganatcctgttaaaaatggtttggattcccttggggaaatgggccttaaaaaataaaatgtaataaagtcagagtgggtggtattgaaaacattccctagtgatcatgtagtaaatgtagggttaagcatggacagccagagctttctatgtactgttaaaatttgaggtcacatattttcttttgtatcctggcaaatactcctgcaggccaggaagtataatagcaaaaaagttgaacaaagatgaacctaatgtattacattaccattgccactgatttttttttaaatgggnaaatgacccttgtatataaaatattggccatatcatggta

SEQ ID NO: 33608 - DNA, 192 bp, Homo sapiens
  misc_feature 11, 13, 191: n = A,T,C or G
tggctcggggnanctctgccctatcaaactttcgatggtagtcgccgtgcctaccatggtgaccacgggtgacggggaatcagggttcgattccggaagagggagcctgagaaacggctaccacatccaaaggaaaggcagcaggcgcgcaaattacccactcccgacccggggaggtagtgacgaaaaana

SEQ ID NO: 33609 - DNA, 478 bp, Homo sapiens
gaagatgtagctgtgtagtctccttcctagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctgcgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaat

SEQ ID NO: 33610 - DNA, 336 bp, Homo sapiens
  misc_feature 8, 10: n = A,T,C or G
tgccgtcngncctcttgtcgtgtgtgcctgatttgagtggcttagccttgcccacagcgccaacctcttctgtccctttcagtcatttgctgtaccttccctgtggcaccgttaccatggaagcccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaac

SEQ ID NO: 33611 - DNA, 238 bp, Homo sapiens
  misc_feature 6, 10, 20, 22, 29, 31, 34, 43: n = A,T,C or G
aggtcnttcnaagaaaaaancnttttgcntnccnaagtaaatnagtatttttgaaaggtgccttctcttggttttttggtttattagcctagttcctgtaagcctttccacccagaaccttgaggcaaatcgtaagggaagcctgtttcttttaaaacacaaacccaccaccaaaaatttaaatgtacatattgcttaagtatttggctgtttttattttttaaaaggtataaacact

SEQ ID NO: 33612 - DNA, 473 bp, Homo sapiens
actgactggttaggttcttctacactaaacaagattgggagaagctattaggttatctaatgtgcagaaaacaacacagagggtaaaggcaaatgaagaaatggggaagtatgttccaaatagagaaacaagataaattcaaaaaatacctgaaggagaagaaagaaaaagtgagagaaaacactttcaaagatgtaaaggcagaaaactactcaagcctggggaaatagaactccagatctagaaaattcaaaggacaccgaatactatccatccaaagagatccttattaagacatgttataatcaatttgtcaaaaattaaagacagagtattttttaaaaagcaacaatgaaaaagcaacatgttaaatacaagggtcccccacaagactatcatcagatttttcatgagaaaccttgcatgccagagttagtggggattcaaaatcctctgagaaaaaagacctgcca

SEQ ID NO: 33613 - DNA, 497 bp, Homo sapiens
  misc_feature 4, 413: n = A,T,C or G
aganaatgtgggcctccaagcagatgcagcagatccgcatgtcccttcgcgggaaggctgtggtgctgatgggcaagaacacccatgatgcgcaaggcccatcccgagggcaccctggaaaacaaccccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgccagcttgatcaagactggagacaaagnggggagccagcgaagccacgctgctgaacatgctcaacatctcccccttctcctttgggctggtcatccagccaggtgttcgac

SEQ ID NO: 33614 - DNA, 456 bp, Homo sapiens
gatagatagatccgagaagcaatcaatagcatagagatagatgatagatagatagatagatagatagatagatagatagatagatctagagaaacagaatcaatagtgtagagtgatagatgatagatagatagatagatagatagatagatagatagatagatccagaggaacagaatcaataatggagagagagagaggtgatagaaacagagatgatagggatgagatagatagaaaatagatatagatagaagatagctagctagctagatagatagatagatagatagatagatagatagatagatagataatgatagagatagatggatagatggatattataaggaattggctcctgtaattagaaaggctggcaagtccaaaatccgcagagctgatatcccagtttgaagaccatcaggcaggaagaattccctcttacttggggga

SEQ ID NO: 33615 - DNA, 417 bp, Homo sapiens
  misc_feature 3, 14, 42, 48, 54, 95, 96: n = A,T,C or G
aanttcggccattnttgggcccggggcctttcggcccggaanccgccntcttcngtaattcgccaaaatgaccgaaaccaccaaagggaaaaganngagaggcaccccgatatatgttctctaggcccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcatttgttgtaaacaaacaagttaagggcaagattcttgccaagagaattaatgtgcgtatttgagcacattaagcactctaagagccgagatagcttcctgaaacgtgtgaagggaaaatgac

SEQ ID NO: 33616 - DNA, 424 bp, Homo sapiens
  misc_feature 6, 24, 28, 45, 50, 54, 66, 70: n = A,T,C or G
tccccngggaaatttcggcaattnattnggccgggcagaaatccnttctntganagtttgcaggcnaaanaatgtaatgttgcagatccgcaggcagaagcctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagc

SEQ ID NO: 33617 - DNA, 390 bp, Homo sapiens
  misc_feature 5, 8, 31, 51, 60, 84, 250, 368, 388: n = A,T,C or G
aagangtnaaatttaaattagttaacattcnaaacgcagcctccccaatcncacctagcnacatttcaagtgccttgagagccntgccatgattagtggttacccctattgaataggtcagaagtagaatcttttcatcatcacagaaagttctattggacggtgctcttctagatcatcataagactacagagcacttttcaaagctcatgcatgttcatcatgttagtgtcgtattttgagctggggntttgagactccccttagagatagagaaacagacccaagaaatgtgctcaattgcaatgggccacatacctagatctccagatgtcatttcccctctcttatttaagttatggtaagantacctaaacaattaaagctncc

SEQ ID NO: 33618 - DNA, 367 bp, Homo sapiens
  misc_feature 9, 22, 30, 31, 32, 36, 41, 42, 46, 48, 68, 73, 77, 100, 105,119, 135, 190: n = A,T,C or G
tggggcccngggggtggcccantggtcacnnntaanggaannggcntntttggaaaaagggtttaacnaggantacnagcctcgggagtttggtgaagcncctcntacctgccaagganctttaaaattagttcnagtattaaaaattggtccgtttttttccttgtgcctgacctaacctattaagccntgatccttgttaatgccatttttgatggggaagaaaaggtaccatgtttacaaagaggttttatgaaaagaataaaaattgacttcttgcttgtacatataggagcaatactattatattatggtagtccgttaacactacttaaaagtttaggggtttctctttgggttggagagt

SEQ ID NO: 33619 - DNA, 422 bp, Homo sapiens
  misc_feature 3, 26, 27, 30: n = A,T,C or G
gcngtaaaatactggcaaaccgaatnngcngcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaattcaacaacccttcatgctaaaaattctcaataaattaggtattgatgggacgtatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaagga

SEQ ID NO: 33620 - DNA, 321 bp, Homo sapiens
  misc_feature 4, 8, 38, 302: n = A,T,C or G
gatntganttaatagaagagcccttcattcccttgccngagccctggtgttgcttaatcttttagtagttccactaaagcttttggtttctaagccccaaatgagattacaaccagcaaattttaaagaagtggagctaagagagacgagtatagtaataacaagtctgaaaaactgcaagaggacacaagaattctgagtgagcctggtagtttctagtgagatttccatttaaagttttgatagttaaccttccatggactatctcagatcattctttggattcataaagtattttttgngtaagtttccttgccatag

SEQ ID NO: 33621 - DNA, 138 bp, Homo sapiens
  misc_feature 4, 16, 30: n = A,T,C or G
tccntagttatgtccnaagctccctttacnggttatacaaccccgtgtgtcatctctgtattaggttgtaaaatttctctaacaacctgaagttgctgaacaccaaattgtggagaggttaaacaaagaaataagtgc

SEQ ID NO: 33622 - DNA, 196 bp, Homo sapiens
agggaaagctaaatagcaatgcaagaactaatatagagtaaggccacaatctatgatatacataagaagcacatataggctgggcacagtggctcacacctgtagccccagcagtttgggaggctgagttgagaggaagatgtgagcacaagagttcaagaccagcctgagcaacacagcaagactctgtctctac

SEQ ID NO: 33623 - DNA, 338 bp, Homo sapiens
ggtagcgtcggcggcttttggcatggcgactttttctggcccggctgggccaatcctgtcgcttaatccgcaggaagatgtcgagtttcaaaagggagggtggcgcaggttcgcaagcgcataacccagcgaaaaaaacaaagaaacaactttactccctgggagtagtcttatgtgcgcccaccctaccctaaaccctactttgacgaaaaccccagatctttctcattattttctccccagttttgggcacttgtgacacgggtttcagggctgtcccagaaagtaaaaagggactgggaaaatagcaaaggctatgcatttgtgggaagtttgga

SEQ ID NO: 33624 - DNA, 449 bp, Homo sapiens
  misc_feature 373: n = A,T,C or G
attaatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactggggagactcctgtcttttaccctcccctcgttccagacctgcctcatggtggcaacatggttcttgaacaattaaagaaacaaatgactttttggaatagccctgtctagggcaaactgtggcccccangagacactacccttccatgccccagacctctgtcttgcatgtgacaattgacaatctggactaccccaagatggca

SEQ ID NO: 33625 - DNA, 343 bp, Homo sapiens
  misc_feature 1, 3, 28, 29, 35, 57, 61, 73, 80, 117: n = A,T,C or G
ntnggccggggctttccggcgggtggannatttcnagcccggcggttccggggccgncggnctctccattccngaaaccntggccccaatttgtcccgtaacccttgtggagaaganccccggcgcctggtgaaccgctgctgtgacttacctcgaagccctcgattggccacattttggtacctacgcccaaggttgagcctggttcctcccacccctgctgagatccctagagctattcagagcctgaaaaaaatagtcaatagtgctcagactggtagcttcaaacagctcacagttaagggaagctgtgctgaatgggttttgggtggccactgaggtg

SEQ ID NO: 33626 - DNA, 305 bp, Homo sapiens
  misc_feature 8, 11, 44, 50, 121: n = A,T,C or G
tccggccnctntgggccggggtatttttttaccatgaatatccnttttcngaattgtgatccaatatgccaagagtcataaatatgccctttacaataaggaggaggcaaggcaaatgccntagatgtacaaatatatgtaccacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaatt

SEQ ID NO: 33627 - DNA, 389 bp, Homo sapiens
  misc_feature 15, 16, 32, 35, 47, 57, 63, 74, 80, 83, 102, 127, 281: n = A,T,C or G
cccgggaattcggcnnttatggcccggggccnctntggaaaaaatantatgaggatntatccncgctgcacacnttttcnatngggatatatgatcctcccngagatgctctgagactaagaagtgnaaatgactactttctgatgtcccagccgcaccctcttttatgaaatcatcttgtctaggaaaatgttcagtggaagagacacatcactgcctgcatggaagaactgtaattatttcctcactaattctgacattttcctgacttattatgtttnggtgtcatgattaaagaaaaaagaattctgctcttcctgcttgctaatagggttctgagccctcttaactattctgtgactttttgtaacatcctgggtgactggcag

SEQ ID NO: 33628 - DNA, 284 bp, Homo sapiens
  misc_feature 10, 18, 35, 36, 51: n = A,T,C or G
ccccgggaanttcggccntttaatgggcccgggannaggaacctggatccntaccctatgttaattacccttatagaacctacctaaagttccagtagttaggcccttcatttaatgtgcattaggcaccttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaacg

SEQ ID NO: 33629 - DNA, 229 bp, Homo sapiens
  misc_feature 9, 10, 64: n = A,T,C or G
ctccggccnnttatgggccggggttggtaaatgtttaatttgcatgtttgactgctgggaagancctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggcttt

SEQ ID NO: 33630 - DNA, 214 bp, Homo sapiens
gggttgttgatctttgcagtaatttctaggagcctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactaccc

SEQ ID NO: 33631 - DNA, 155 bp, Homo sapiens
ctgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 33632 - DNA, 419 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgaggggaagaaaaaaaatctctttttttctgggaggctg

SEQ ID NO: 33633 - DNA, 426 bp, Homo sapiens
  misc_feature 2, 7, 36, 38, 50, 414: n = A,T,C or G
cnccccngggaattcggcccttatggcccggggagncnttgaggcagccngcgcaggggccttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaanggtgacttaaac

SEQ ID NO: 33634 - DNA, 319 bp, Homo sapiens
  misc_feature 2, 13, 31, 33: n = A,T,C or G
anctggagtcttnggcctaccgttgcccccnanggcctgggtccttgaaactccctgggtggttaaagcccatttcctctgccctcagcccttctaaagtgcctgtggttaccagggtgtgagcccacctaagccccagcccaaggaagatgtttttattgttcacgttttatagaagaagggatagaaacatgggaaaggtacataacttgcataaggttataaaattggcaaatgatagaattgctattcacgcccaggtctgtttaaatcttgaacccaagctcttaatgtctgtactctgctatgaaatgggaga

SEQ ID NO: 33635 - DNA, 121 bp, Homo sapiens
  misc_feature 17, 31, 43: n = A,T,C or G
cccgggaaattcggccnttatggcccgggcnagcctataaccnccaaaaataatgaattgatgagaaatacagtgaagaggcaatgtccatctcaaaatactgcttttacaaaagcagaat

SEQ ID NO: 33636 - DNA, 354 bp, Homo sapiens
  misc_feature 9, 10, 336, 337: n = A,T,C or G
aattcggcnnttatggcccgggatacctttataaagtagcccgatttagatttaaagagacttcaattctctaaagaatgaatgtatcattcattgttatagaggattgcaacagagcaaaaataagggactatttttaaaagacctgttatttctgggatagtaccactttatataaaattaaaataataaatatatagaaatgcaattaccaattatttatttttattctctgacaggtattttctctgagggacttagaacaggcaccaaaaaaaaaggatgatgctaaaaattgatatgtaaaaagctgatacccaaatatctggtatttgnngtttgggaggaataaac

SEQ ID NO: 33637 - DNA, 131 bp, Homo sapiens
  misc_feature 5: n = A,T,C or G
atttnatctgattttattatttcttaaattttagattttattgagtaccatttatatgattgtacaagcattcactctttagtagcattttttgtttttcagacaagctgaagtggttttattaagaattt

SEQ ID NO: 33638 - DNA, 100 bp, Homo sapiens
  misc_feature 100: n = A,T,C or G
gcgcctctcctgtcacaaatgctgcactattggttcttaagttttttatctccagatcctaatttatgcctatgcaaaaaataaatgacgcccaagagcn

SEQ ID NO: 33639 - DNA, 150 bp, Homo sapiens
  misc_feature 3, 8, 150: n = A,T,C or G
atnggccngggggttgcgcagtagtgctagccggcttcgcggttcggtcctcgcacccggcagccgccactggtgctgagctgctaggaagcccctatcgccgagctcgttggagcttgaacccattgtcacccctccgactcaccggcn

SEQ ID NO: 33640 - DNA, 342 bp, Homo sapiens
agggggtggcttggtgaacaggcccttggtgcagagggaactgggacaccatcatggccagtgccacccagctgtgatgtccggcattcctttgccatgatttaggggcggagcaaccacacaattagaatcctcacactgactcatcagtcaccctttctccctggagagcagaatacacattgactaatgctctttctggaatattccacacagaaccctgcccttctcttaccacatgaatgctgtggcaggcaagctatagcggatggaagatggcagtgttttcaaagtgtgcatcctggactacctgccttagaatttctgggagggcttgttgga

SEQ ID NO: 33641 - DNA, 122 bp, Homo sapiens
  misc_feature 5: n = A,T,C or G
tggtnaccaaggcagtgcatgcatgttggggtttcctttaccttttctataagttgtaccaaaacatccacttaagttctttgatttgtaccattccttcaaataaagaaatttggtaccca

SEQ ID NO: 33642 - DNA, 266 bp, Homo sapiens
  misc_feature 2: n = A,T,C or G
cngacacccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggttt

SEQ ID NO: 33643 - DNA, 311 bp, Homo sapiens
ggcacaagcctgtaacatggcggcagcgactgcggcctgaactctagggagccgggttgatttttaaagcttcaaaatcctaagactcagcactgttgcggggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtga

SEQ ID NO: 33644 - DNA, 299 bp, Homo sapiens
attctagtaatggtacacagccctaagtggagaaggagagatgcaggcaatttggtggagggaggttagctgggtttattaaaaaccaaccgagggacaatgcatacatgcagcagtgaccaatggcatgtctcccttttcttttgctaaagctcctccattgggggatgattttattttattcttatttttatttatttattttttgactcttgacaattgctatccaatagcttttcctttcctttttagaaaacatgccttactttgggcttccaacttgaaatctgaggctggga

SEQ ID NO: 33645 - DNA, 379 bp, Homo sapiens
  misc_feature 15, 16: n = A,T,C or G
cccgggaattcggcnnttatggcccgggatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagagattgtaattttcacttaaaattttctttaaggatataagaggtttataattgatgtagttaaattgaacaataaccattggtgactggagcaggtaattatagcctgcagaaaaaattatctaagaattttaaaaataagatcctggaagttgtttaattgcatccatttctgtattttatggtgaatttataaactg

SEQ ID NO: 33646 - DNA, 339 bp, Homo sapiens
tcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacac

SEQ ID NO: 33647 - DNA, 266 bp, Homo sapiens
  misc_feature 10: n = A,T,C or G
actcttaatngtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 33648 - DNA, 376 bp, Homo sapiens
attaacattaagtacctaaaatagtggcagacaggagtagctcaataataaataataaaataaggtaaagaatatataataaagtaataagtaatataacataaaatgtgaataatagggttccacaaatggaagtgccaacaattggagaagagacaataattcaaaaattaatagaagaaaattttattcagatgaagaaagacaaatagtctacatttttcataataagaggtacctacttagtgttttctggtgctacaagtttcatttgcaaaaaaggagaaaagaaaataagaatagtgtctcatctgcaacttcagctgttagaatatatttacaataaattacagactatttgaaagacagctagagc

SEQ ID NO: 33649 - DNA, 239 bp, Homo sapiens
gagagcggacagggcgatggcaggttcgccgggtgtgaggcttcacagcggtccggtgaccaagtcgagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtct

SEQ ID NO: 33650 - DNA, 278 bp, Homo sapiens
ggagatccgagccggggatgtgggagagtctgggctccaggccagcattgagtggctgctgagaccgagataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacga

SEQ ID NO: 33651 - DNA, 129 bp, Homo sapiens
aagacaaatgggactgatgtcatcttgagctcttcatttattttgactgtgatttatttggagtggaggcattgtttttaagaaaaacatgtcatgtaggttgtctaaaaataaaatgcatttaaaccc

SEQ ID NO: 33652 - DNA, 318 bp, Homo sapiens
caccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 33653 - DNA, 159 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 33654 - DNA, 401 bp, Homo sapiens
ggagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagctcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcaga

SEQ ID NO: 33655 - DNA, 455 bp, Homo sapiens
agtgatatatggtataaagaaagtaaaatagggcaagaaagcttctgtctgatacgaacttgaacacatcaatattactgctgataacaactccaaaagacaggttaaatataaaaataatttgtttaacagcttcaaggggtgttaaagcaaggagtcctagagcgactaaagctccagagaggtgataattttggagagatgaactgataatctgcagttgcttttctcttggggaagtggtcagactgctgattctgtgtataggcaagaggctaaaaatctgagctcagcctgtctagagggttactctttgaggacacagaaataggtagagcttttggaaatcttgtcgtgtgaagcaacaatattggagacccaaaaggactaaaaaatattgctgtctccttctcaagacatttgcagaattatgaagctgcgtggcagattattat

SEQ ID NO: 33656 - DNA, 335 bp, Homo sapiens
acagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtatagg

SEQ ID NO: 33657 - DNA, 315 bp, Homo sapiens
gtcttacccacttgcgactgatctttgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacat

SEQ ID NO: 33658 - DNA, 413 bp, Homo sapiens
atttataactttttaattatttaattgaaaggcatgagatttccaaccctcccttctctccaagaagcaaacccccaaattgtcccaatttttttcttccctcccacaaaaaccttatcactttatccaaaaaaaagcttgttagaaatacttaagacagctacaaagttgaaggcatccatcatgcctttgaggagaatggagttttgattgtctaaagtagtcccgtgtttaaaagaagacataccttgtacatgactgaaaataaatggctccttttaaaattcttaacattaggaaaagacaccccctaggtcagctccaagagatcattagattcagtttaaggcccaaagcaaacctaataatgaatattattatatggcatgtattacctttattcatatatcaga

SEQ ID NO: 33659 - DNA, 148 bp, Homo sapiens
ctcagcaaccgattgagagcatccgcagccccgaggctcccgcaagaaccctgctcgcacctgcagagacctgaaactctgccaccctgagtggaagagtggagactactggattgaccccaaccaaggctgcaccttggacgccatg

SEQ ID NO: 33660 - DNA, 134 bp, Homo sapiens
acgacaggcttacgtagaagcttttgtgagatttttaagttgttatttctgattagaactctgtaaccctcagcaagtttcatttttgtcatgacaatgtaggaattgctgaattaaatgtttagaaggatgac

SEQ ID NO: 33661 - DNA, 282 bp, Homo sapiens
tatacttaacatatttgcccactatatcactcgtgaatattgacccaagagaaacgaaagcatatgccatacaaatacttatttgtgaatgttcaaagcaacttaatttttaagagtcaaaaactagaaacagctcaacattcaagaggtgaaatgataaatttttgttatatccataaaattggagtgctactcagaaattcaaacaatgactatttgatttatgcaactacatggatacacccagtgttctgctggcaaatgtttaaaaactggctctcc

SEQ ID NO: 33662 - DNA, 378 bp, Homo sapiens
ggctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaaga

SEQ ID NO: 33663 - DNA, 298 bp, Homo sapiens
ctccaacatggaagctgtcttaaatatctgtgtaaagtctactaacttcctgttgactgaagcaaattagaggagtgaatttagagtccaagttcaaggtagtcaccctgcctatggtgggaggatactgcaggattatatgacaaaatgtagggtacttagaaacatttacaaaattgctgaatattttaattaaaatttaaacaaaaaacagacttgaatgtaaatttgccaaagacctaagcataagaaacatgtttgataaacattattcattgtctgacaacgctgaatagga

SEQ ID NO: 33664 - DNA, 381 bp, Homo sapiens
  misc_feature 11, 38: n = A,T,C or G
caactggaacngcagtgaatcttaatgttccttaaatnagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcaattttttaaaaataaatagagcatatgaagtactcaaagatgaagatctacggaaaaagtatgacaaatatggagaaaagggacttgaggataatt

SEQ ID NO: 33665 - DNA, 455 bp, Homo sapiens
  misc_feature 7, 20: n = A,T,C or G
tcccccngggaaattcggcncttatggcccgggagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaat

SEQ ID NO: 33666 - DNA, 396 bp, Homo sapiens
agggtaagttatctccgatgcgaaataactattacatgaagcaagaggatacaagctgtacaagcggtagactatagaagatgttgtcatgcattgttcagataccctcttcagggttaaagtacttacacccctagctgctgggagtgtcaaacacttgcagttcacagctgagtcctctactgggaatcgccctacgctgaaaggtttctgctgggcccagacaagttggattttgagaaagagaaataaattaatatgaagaaaatgaagtttcaacattaaaactgaaatcaacatgcaaatctgaggaacagcaaaagcaaacacgaaaagcttgaaagggtacccttttattatggaaagaagaataatgtgtgattaaaatttttgcat

SEQ ID NO: 33667 - DNA, 343 bp, Homo sapiens
ctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 33668 - DNA, 348 bp, Homo sapiens
  misc_feature 21, 339, 343, 346: n = A,T,C or G
caagaataatgtgaatatttnacataaatatctatgctgaattggcttctagatttcagaacaggaagaacatcttcagtgatgctcatgatttggatttgctttgctgcggagtaggtttagcgacaaattccatctggctggagctacatgcagtctctctattgattggttatattgggacttcatgggagtgtccttcaatttgcttttcccagcatttttaaaaagctccattggaaaaaaaaaatagagactagaaaagaaaaaaggaacctgcattgtttcagtttgcatccaacatgcaaaacatagttctaaatttttaattagctaagngagnggnga

SEQ ID NO: 33669 - DNA, 398 bp, Homo sapiens
ctcctgactctgtttctggcacaagataactcacctcccttgataaatgaggccaaataaataatttcttgtcaccatcttgtccttttctttttttcaatggcccaccttagactaagttgtcaactttaaaatattaaaatcataggtttctagcacaggccgttaaaaaaatggtagtaaagttcaaagcccaggtgtatcctggcacagccagttaggtaattgaaagaacaaaggtgaatgaagaggaagtgatgctgcacatatatggcctttgaaggctcttctgacttgagaagaatgacatggaggcatttatatgttttcttatgatttattcttctattgattaatagaatacttgataattaatattaggcctttgtagcataaga

SEQ ID NO: 33670 - DNA, 396 bp, Homo sapiens
  misc_feature 107, 390, 393: n = A,T,C or G
cgagtgacaccattgagaatgtcaaggcaaagatccaagacaaggaaggcatccctcctgaccagcagaggttgatctttgccggaaaacagctggaagatggtcgnaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagcttggaagatggacgcaccctgtctgactacaacatccagaaagagtccaccctgcacctggtgctccgnctnaga

SEQ ID NO: 33671 - DNA, 219 bp, Homo sapiens
agagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagac

SEQ ID NO: 33672 - DNA, 212 bp, Homo sapiens
  misc_feature 9, 17: n = A,T,C or G
gacacaggnatccgganctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagag

SEQ ID NO: 33673 - DNA, 414 bp, Homo sapiens
  misc_feature 26: n = A,T,C or G
gcttctttgctgcgtctactgcgagnaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgaga

SEQ ID NO: 33674 - DNA, 470 bp, Homo sapiens
ggcccaagtatgaagtctgtagctggaagaatagattcagtgttgggacaagaggtgctcttgacattgaagataagccaggagtgagaaatactgtcaccaagtctctgggatgccccttgccagcactaccccatgatggcaatgccaaacttaagattgtatctcctctccagcatcacaagtaatcagtaagattggttctttggacataggaagagtagcaacctcttgctggagtagtaggagaggcctgtgtctgagcacagcatgtgaatggtatagatcatctagccatgccatatgcatggagaaaatagatatctatgtagaagtaaagaactaaaaatgctgtacttgtgaaatgccctaacacaggaggctcaggccttgggtggcatggagtgactatagcttaacataactctgggaaagaaaggcatcttctccctttcccgaaaggctgagga

SEQ ID NO: 33675 - DNA, 324 bp, Homo sapiens
aagggaactgagaccagagaaagaacccaagtagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgc

SEQ ID NO: 33676 - DNA, 471 bp, Homo sapiens
catgcagatgtagaagagagcgaagtgattgtgtttttctttggattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcatgggattccagttattatggagtgcttccatccctctccaccccttccccccaaaaggttttctttgcaagtgcttttggaactaagagctagtatcttggattaactgatgcctgctagtgctttc

SEQ ID NO: 33677 - DNA, 213 bp, Homo sapiens
  misc_feature 7, 31, 32, 174: n = A,T,C or G
gagtctnatggatgacatcccagcctctgannagtaacatccggaatgtgttgtagcattccagtgtgttgtaacattcctgtagcattccaatgtgttgtagcattctggtgtgttgtagcattcctgtaacattctggtgtgttgtaacagttccggtgtgttgtaacattnggtgttgcgcggtgtgttgtaactttctggtgtgtgcgt

SEQ ID NO: 33678 - DNA, 332 bp, Homo sapiens
ggagaattttctccttccaagtacagtgtaagaacagactggaagagaagttaccccgatgacttggtttggaaggggttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgatgatctgttaaattcttagtgaagtttccttgatttccagtggctgctgttgtttgagtttggtttggagcaaaactgaggtagtcctaacatttctgggactgaatcca

SEQ ID NO: 33679 - DNA, 398 bp, Homo sapiens
agggaaaggattccctagttaataaatggtgttgggaaaactggctagccatatgcagaaaactgaaactggatcccttccttacaccttatacaaatttaactcaagatggattaaagacttaaatgtaagctctaaaaccataaaaaccctagaagaaaacctaggcaataccattcaggacataggcatgggcaaagacttcatggctaaaacaccaaaagcaatggcaatagaagccaaaattgacaaatgggacctaattaaactaaagaccttctgcacagcaaaagaaactaccatcagagtgaacagacaacctacagaatgggagaaaatttttgcagtgtatccacctgacaaagggctaatattcagaatctacaaagagcttaagc

SEQ ID NO: 33680 - DNA, 260 bp, Homo sapiens
  misc_feature 26: n = A,T,C or G
ggagagagagactggagacgcacagnatccccccaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgc

SEQ ID NO: 33681 - DNA, 455 bp, Homo sapiens
gggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtaga

SEQ ID NO: 33682 - DNA, 392 bp, Homo sapiens
ggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaaga

SEQ ID NO: 33683 - DNA, 363 bp, Homo sapiens
ggtgtgtttccaaaatggcggcagcgatggatgtggataccccgagcggcaccaacagcggcgcgggcaagaagcgctttgaagtgaaaaagcatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 33684 - DNA, 371 bp, Homo sapiens
  misc_feature 23: n = A,T,C or G
gggaggggcgcgaggtttcaagnatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatg

SEQ ID NO: 33685 - DNA, 384 bp, Homo sapiens
gaatagagactcaaagtagtgaataataagtccttgttttcatgggggtgggcatgagaggacagtataagttagagatagagaccattaaaggaaaaagcattttgggccagcgcagtggctcacacctataatcccagcactttgggaggctgaggcaggcagatcacaaggtcaggagatcgaggctatcttggctaacacggtgaaaccccatctctactaaaaatacaaaaaattagccgggcgtggtggcaggtgcctgtagtcccagctactcaggaggctgaggcaggagaatggcatgaacccgggaggtggagcttgcagtgagccaagatcatgccactgcactccagcctgggcgacggagcaagactccac

SEQ ID NO: 33686 - DNA, 104 bp, Homo sapiens
  misc_feature 16, 31, 41: n = A,T,C or G
aagaaaaactggcagnaatgtccgggccttntatatcaagnagcaccatgggcaagccccagcgcctatattaaggcacatttgaataaattctattaccagtt

SEQ ID NO: 33687 - DNA, 398 bp, Homo sapiens
ggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctat

SEQ ID NO: 33688 - DNA, 128 bp, Homo sapiens
tgtgcctaaacaaacctcaaaaaaacgaaacggaatgaggaggaagaaagtacatcccagattgaaagaccactttcgcaagaacctgccaaaaaagtgaaagcgaagaagaaacacactaacgcaga

SEQ ID NO: 33689 - DNA, 399 bp, Homo sapiens
  misc_feature 21: n = A,T,C or G
aactcttaaagaaataaaatnctaatcgcaaacctcccaccaaagaaaagcccagggccagttggctttactggggaagtctacccaacacttaaagaaaaattaatgccagtccttctcaaactcttccaaaaatttgaagaggagtgaacactctctcacttgctctatgaagggagcattatcctgacgtcaaaactagaggcattataagaaaagaaaactacagaccaatgtccctaatgaatacagatgcaaaatttcttaacaatactagcaaaccattcagtagtataattaaagggattgtacaccttaaccaagtagatttattccaggaatgcaaggatgttcaacgtatagaaattaatcagtgtaatgtcccacattaatagaatg

SEQ ID NO: 33690 - DNA, 404 bp, Homo sapiens
atggcaaattggttacaaaatgtcggaaaggctggagatgcaaaaaagaaggtggtgcagttacccagagattgatgacaatatgaagtcactagcacataagcctggaagtaaaggggagaatgctgttactcagagtccacactcactgtaactagggttactggagtatccacccatgctgtgggcccattggaaccacaacagctactaccttgcggaaagccaggagtcaagaaactcaagagttacctgcgcccaccacagctgttgttggaatgagatccaaggctgccagagtgtgcactgcttccgtcacctctgaaaccatgcttctagagcaagaagcctggacctcacacatacctactgctgttgttaccgcctaggacaaggtcagaaac

SEQ ID NO: 33691 - DNA, 305 bp, Homo sapiens
gggccgaggaagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagacaacattagagatgtcagcaaatttttggaaga

SEQ ID NO: 33692 - DNA, 227 bp, Homo sapiens
  misc_feature 17: n = A,T,C or G
gggcggatcatgaggtnaggagatcgagactatcctggccaacatggtgaaaccccatctctactaaaaatacaaaaattagctgagcgtggtggtgagtgcctgtaatcccagctacttgggaggctgaggcaggagaattgcttgaacccaggaggtggaaattgcagtgagccaagatcacgccattgtactccagcctgggtaacggggtgagactccgtccg

SEQ ID NO: 33693 - DNA, 261 bp, Homo sapiens
  misc_feature 260, 261: n = A,T,C or G
ggttgttctttcctcacatttggatgattgtcataaggtttttagcatgttcctccttttcttcaccctccccttttttcttctattaatcaagagaaacttcaaagttaatgggatggtcggatctcgcaggctgagaactcgttcacctccaagcatttcatgaaaaagctgcttcttattaatcatacaaactctcaccatgatgtgaagagtttcacaaatccttcaaaataaaaagtaatgacttagaaactgcnn

SEQ ID NO: 33694 - DNA, 399 bp, Homo sapiens
tgaagaagagtgggtggctcctgcctgtgctgtggaaggttttatttatcggttaccacttcattctccagcctgtagtgcccgactttgggttggaagctggtaattattgaattagacctcctgtttttcataggcatgtttgtaaccaagctaggctgtcatttaattttaaccttaagaattgtcagccgggtacggtggctcacgcctgtaatcccagcacttcgggaggctgaggtgggcggatcacctgaggtcaggagttcgagaccatcctggccaacgtggggaagccccatctctactaaaaataccaaaattagcatgcatggtggcgggcgcctgtaatcccagctactcaagaggctgaggcaggagaaccgcttgaacccagga

SEQ ID NO: 33695 - DNA, 102 bp, Homo sapiens
gatgccgaccggcgatgcggcggcgttattcccatgacccgccgggcagcttccgggaaaccaaagtctttgggttccggggggagtatggttgcaaagctg

SEQ ID NO: 33696 - DNA, 368 bp, Homo sapiens
cacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtgg

SEQ ID NO: 33697 - DNA, 110 bp, Homo sapiens
agggaagcctgtgatgactacagactttgcgaacgctacgccatggtttatggatacaatgctgcctataatcgctacttcaggaagcgccgagggaccaaatgagactg

SEQ ID NO: 33698 - DNA, 348 bp, Homo sapiens
agggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatac

SEQ ID NO: 33699 - DNA, 245 bp, Homo sapiens
  misc_feature 14: n = A,T,C or G
atctgataacaatnaaatctgaatgacaaaaacagctgcattcactgcgtgatgattgtatgttaggtattgtttgaagtgctttacatgtgttagctcacttgatcctcagaacagccttttgcagttgttaccattatcctcatttgacaaagaagaaaactggggcactagagcccatgttctgaaccacatgctaaactgcctgccttatgaaaagacagtgaaaatgagaaaagagaatt

SEQ ID NO: 33700 - DNA, 356 bp, Homo sapiens
caataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagagga

SEQ ID NO: 33701 - DNA, 320 bp, Homo sapiens
gcaccacacagtatcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgaga

SEQ ID NO: 33702 - DNA, 183 bp, Homo sapiens
aagctgagaggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtggttttgttttttgggttttt

SEQ ID NO: 33703 - DNA, 359 bp, Homo sapiens
gattgggcggaagggtcgctggcactccgttggtcttccagctggtgggagttgtcgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaaga

SEQ ID NO: 33704 - DNA, 141 bp, Homo sapiens
caatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 33705 - DNA, 433 bp, Homo sapiens
  misc_feature 15: n = A,T,C or G
aaaggaaggcaaagnaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttat

SEQ ID NO: 33706 - DNA, 392 bp, Homo sapiens
  misc_feature 9, 25: n = A,T,C or G
ggagcattnacacctttggtgaagntggaacgactttatctgtccaagaaatcagctgaaggaattgccagaaaaaatgcccaaaactcttcaggagctgcgtgcccatgagaatgagatcaccaaagtgcgaaaagttactttcaatggaccgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattga

SEQ ID NO: 33707 - DNA, 161 bp, Homo sapiens
  misc_feature 6: n = A,T,C or G
ctatgnatagtattagagaaagcagacatttgcattcatttataggagtttcataacctagtgagatagagagagttgatagtattgacaagtagtgttcaagataatggagatatatacatcatctcaaagtgcacatgtagatgtggaccatgaaatac

SEQ ID NO: 33708 - DNA, 434 bp, Homo sapiens
agactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggaga

SEQ ID NO: 33709 - DNA, 368 bp, Homo sapiens
atttgtgtggggacagtgtcaggtgcaaggtatatgtggctgttcacgagccggccctagacggaaaacactctaaggataacaatagctgctcttgattcttatttctggggtagcagtgggtcagtcaaggcaaagccgggctgtcatggtgtcctctttcagggagatgtcatgggcacaggcatggggatcagtcttgcccctgggggcaggcacaggaagtccaatgcataaaacctttggctgaggcttacttaaggttcctttcctttttttctttcctcccttgtacatagtttaaactctccacactaggtcattcaggcctggagtcaccagaaaaaaagaagtcactgtttggggga

SEQ ID NO: 33710 - DNA, 236 bp, Homo sapiens
  misc_feature 3, 228: n = A,T,C or G
tcnctgatttcactttctttattctacaaaataagaaaaataatatctatattgcatggttgttatagggattacataaaataaatagtatagttagcagataagaagataaattattgtaatgcagtaggataaatgttttgatgggcatagacagattatcatggaaagaagtacctagcttagcctggatgggagttcagtggcagggggaggtagaagtagtanaaggtgat

SEQ ID NO: 33711 - DNA, 434 bp, Homo sapiens
cacggcaaatctgccgaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgagg

SEQ ID NO: 33712 - DNA, 122 bp, Homo sapiens
  misc_feature 15: n = A,T,C or G
gagaccagcctggtnacatggtgaaaccccatctctactaaaagcacaaaaattagccagcccatggtggtgcacaactgtaattccagctactctcgaggctgaggcatgagaatcacttg

SEQ ID NO: 33713 - DNA, 175 bp, Homo sapiens
ggtgcgtgacgctcgtcagtggcttcagttcacacgtggcgccagcggaggcaggttgctgtgtttgtgcttccttctacagccaatatgaaaaggcctaagttaaagaaagcaagtaaacgcatgacctgccataagcggtataaaatccaaaaaaaggttcgagaacatcatc

SEQ ID NO: 33714 - DNA, 231 bp, Homo sapiens
aagagaagtcgtttcattcaagttggtgtaatcagttggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacgacg

SEQ ID NO: 33715 - DNA, 377 bp, Homo sapiens; identical to SEQ ID NO: 32439

SEQ ID NO: 33716 - DNA, 235 bp, Homo sapiens
gagatctatactgttggaaaacgcttcaaagtaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 33717 - DNA, 378 bp, Homo sapiens
ggcagcgagttcgacacaccatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtcctt

SEQ ID NO: 33718 - DNA, 337 bp, Homo sapiens
catattctttttgatttaaatgtatgctagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggtaaacttttggttcaattttatatatatttttgtaagctctgtaagggcaggaaccttatttgtgctcttctatgttcccagcactttcagtaggtgctcaataaatatttattgaatgaagga

SEQ ID NO: 33719 - DNA, 357 bp, Homo sapiens
cgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtg

SEQ ID NO: 33720 - DNA, 343 bp, Homo sapiens
agccgggccaatatggtgaaaccccatctctactgaaaatacaaaaattagccaggtgtggcgcacacctgtaatcccagctactcgggaggctgaggcaggagaattgcttgaaccctggaggcagaggctgcagtgagataagatcacaccactgtactccagcctgggctacagagtgagactctgtctccaaaagaaataaaataaaataagtgaatgttggccaggtgtggtggctcatgcctataatcccagcactttgggaggctgaggagaggggatcacttgtggccaggagttcaagaccagcctggccaacatggtgaaaccccatcactac

SEQ ID NO: 33721 - DNA, 136 bp, Homo sapiens
attctaaattaacttcgtttatacagttttgctttatgaactttgtatttttgtaacttgaagccttgaacttaagaaatctttttatttaaatagatttttaaagttcctctaatgtcaagtatactctagtatc

SEQ ID NO: 33722 - DNA, 312 bp, Homo sapiens
tgtggttgctcacacctataatcctaactcttcagaagcccagggtgagcagatagcttgagctcaagactttgggatcatcttgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctgggaggtggaggccgcagtgagcccagattgtgccactgtgctccagcctgggtgatagagccaaacccgtct

SEQ ID NO: 33723 - DNA, 165 bp, Homo sapiens
gatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaactag

SEQ ID NO: 33724 - DNA, 317 bp, Homo sapiens
cacacagcactaaatttaaaaaaaaaagtttttgtttcctttgcatattttgaatttgcacttgctggtaaggttcacttttcgtctgcttgctctttctgttctcatttggtttcttcagcgtgattgactgagacatggctccccaacaaatagccatgacaaatccctggaacctgtgaatgttagtttatttggaaaaatgtctttccagatcttattaagataaagattttgagatgaaaagataattttggattatgtgggtacaccctaaatgttatcgtatgtatcattattagagatcgttagtggga

SEQ ID NO: 33725 - DNA, 207 bp, Homo sapiens
aatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttat

SEQ ID NO: 33726 - DNA, 435 bp, Homo sapiens
tctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttacca

SEQ ID NO: 33727 - DNA, 422 bp, Homo sapiens
  misc_feature 341: n = A,T,C or G
tgacccactgcacctggcctaataaactcctttatctactttctaacattttcgtaattattttataccgtgtgctatgctgcatctgaaatctatgaaatctatcattgtctatagtatactgtgattctccatgtttaatattgtataaaatttaactttatttaatttaaaaaatttacttttaatttttatttaatggctaaattactacttgagataaattttgagaacaacattaacaaaaccacttgaggccaggagtttgagactagcctggtcaacatagtgaaaccccatctctacaaaaagaattaaaaaaaaaattagcctggcatggnggtatttccctgaagtcctaactgcctgggaggctgggacaggaggaatgcttgagctcaggaattcaagacttcaagtga

SEQ ID NO: 33728 - DNA, 376 bp, Homo sapiens
  misc_feature 27: n = A,T,C or G
gaaggaacgagatggcggttctctggnaggctgagtgccgtttgcggtgccctaggaggccgagctctgttgcttcgaactccagtggtcagacctgctcatatctcagcatttcttcaggaccgacctatcccagaatggtgtggagtgcagcgcatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcaga

SEQ ID NO: 33729 - DNA, 201 bp, Homo sapiens
  misc_feature 2, 15: n = A,T,C or G
cngggaaattcggcnttatggccgagagttagttggtgaccacctgcccagagagatgaaaggttcattattagttgagctccactaattctgatttattagtgccaaacacttgccttttgcagctgtgagggaagttttcaaagttgatctatttctgagctgcactagcagtaccacatgtttttttttttctttttt

SEQ ID NO: 33730 - DNA, 340 bp, Homo sapiens
  misc_feature 5, 18: n = A,T,C or G
cagcnccagcttcccagnaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaat

SEQ ID NO: 33731 - DNA, 183 bp, Homo sapiens
catgcaaaaccttccccagcaaaaagattctgactcactgaaggctcagatgattgctaacgcttttttaagcaataaagtgtttgttaattaaggtatgtgaattttttagatataattctattgcacacttaatagactgcagtatagtgtaaacataacttttgtatgctctggaaagcc

SEQ ID NO: 33732 - DNA, 369 bp, Homo sapiens
gacagccagagcctaaaggctagagccggatctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggaga

SEQ ID NO: 33733 - DNA, 440 bp, Homo sapiens
attcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataattttctgctttcagga

SEQ ID NO: 33734 - DNA, 307 bp, Homo sapiens
cacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcat

SEQ ID NO: 33735 - DNA, 386 bp, Homo sapiens
ctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttac

SEQ ID NO: 33736 - DNA, 334 bp, Homo sapiens
  misc_feature 28: n = A,T,C or G
gagaggaacgcgcagccgccttgggaancccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtgga

SEQ ID NO: 33737 - DNA, 140 bp, Homo sapiens
  misc_feature 20: n = A,T,C or G
gtcccccccatgattcaatnacttcccaccagtatccctcctctaacactgggaattacaattcaacaggagatttgggtggggacacagaaccaaaccatatcacacacaaaaagcaactatagaacataaaaaccatg

SEQ ID NO: 33738 - DNA, 373 bp, Homo sapiens
  misc_feature 370: n = A,T,C or G
tatcttaatctttatttccgtagatcattatctaccaggaaaaaaacacattctgttaataatttcattggatcatccttgtgatttagaatgaattgcatactcattctagtgagagagctagtgagagactgcctaaaagtcagaggtccttaaagtagaagtttaatcataacttttctggtttttgtttttttttccttgagatggagtcttgctctgtcacccaggctggagtgcagtggcgtgatcttggctcactgcaaccaccactccccaggttcaagcgattcccctgcctcagcctctcgagtggctgggactgcaagcatgtgtcaccatgcccggctaatttttgtatttttagtanaga

SEQ ID NO: 33739 - DNA, 420 bp, Homo sapiens
  misc_feature 10, 32: n = A,T,C or G
agcctagcanagacggcaatgaagaagataangaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagatggggtttttattatttttacctaaagacgtctctttttg

SEQ ID NO: 33740 - DNA, 300 bp, Homo sapiens
gagaaggcaaaagtctctgaatgtggtaagtgaacacggaaatgattgccaggattttgggatcagaacataaaggaacagaaagaaggcataaaagagatcagttttaaaaataatttgagaaaaggatatttactttgcagttataacaggaacagtaggaaatagaagctaggaggacatgtagacccagcaaatcctgtttgccctgcatgtggaaatagagggaaagatcttaaataaagcagagcataaattcaaaaattgcattctggatctgctgaaagagaagagagtcac

SEQ ID NO: 33741 - DNA, 282 bp, Homo sapiens
  misc_feature 6, 16: n = A,T,C or G
cataanatcaaatttnttgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatcctt

SEQ ID NO: 33742 - DNA, 363 bp, Homo sapiens
  misc_feature 6: n = A,T,C or G
tgggcnttgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtgga

SEQ ID NO: 33743 - DNA, 463 bp, Homo sapiens
aacaacaatattaacaaatagaatttagctatataaaagtaattctactctatgaacaagtagagtttattccagagatacgaggctggttcagtataatccaccatattataataggctagagacgaaaaattacatgaaaacaaaaactacaattgatatggaaaaggcatttgacaaaattcaatacccattcttgatttaaaaaaaaaaatctctcaggaaaactatgaatagagaggaatctcctcaacttgataaagagtacccacaaaaaacctacagctaaaattatacataatatgaaagacaatattttccctccaaaaacaggaaaaaggcaacaatgtctgctcgcactgaccaatggatcagaacagaaaatccagaaagaaacttacacaaaaatgcccagttgacttttgacaaaggtacaaaagcaattcaatagaagtatattctt

SEQ ID NO: 33744 - DNA, 130 bp, Homo sapiens
agccctggagccgataaaccgctgggttgctagacccagaagagaaacaacaatcactgtagtacagctcacaggaagccacatccataggaaaagggggagagtactacatcaagggaacaccctgtgg

SEQ ID NO: 33745 - DNA, 314 bp, Homo sapiens
cttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtat

SEQ ID NO: 33746 - DNA, 404 bp, Homo sapiens
  misc_feature 6: n = A,T,C or G
tgtcantcactttattgtgatattcactttattgtggtggtctggacctgaacttacaatatatctggggtatgtctgtaaatcaaatttctacaggaatgagtcctttagaatgaaacctctctcttctatcaaaagtgtcaagtaaacaaaataactcagcctcacttgtttgggagcagccctgtattctcacaattctaggctgaggtcaggagtgctataacaactatgatgaaaagtgagagtccatagagccctagactcttgtttaccacacataaaggactttgcaccagataaattaggaagttccaagcattgcactgttcgtggcccaaaaatccaaataacctttagtttaaaggcaaagctgtctcagctctagtaactagggattgaga

SEQ ID NO: 33747 - DNA, 438 bp, Homo sapiens
gatttgggaaacaatttaagtcttacatgctcaagattttcttcccccttcacacccacccaaaaagcatcattgactaaaattttaaactaataaccaacagggtattgataccaaaagcagctgttaaagaaatagcacttcaggccaggcacagtggctcacacctataatcccagcactttgagaggccaaggtgggaggatcacttgagcccaagaggtcaagaccagcctggacaacacagtgaaacctcatctctacaaaaaataaaaattagccaggcatggtggcacattcctgtagtaccagatactcaggaggctgaggtggggaggactgcttgagcccaggaggttgaggctgcaatgagtcgtgattgcaccactgcgctccagcctgggtggaatgacagagtgacaccgtgagacagaggga

SEQ ID NO: 33748 - DNA, 388 bp, Homo sapiens
  misc_feature 30: n = A,T,C or G
gattcctgaagctgacagcattcgggccgngtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacat

SEQ ID NO: 33749 - DNA, 160 bp, Homo sapiens
cgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 33750 - DNA, 346 bp, Homo sapiens
  misc_feature 10, 26, 337, 345: n = A,T,C or G
actcacaggnacaaatacaccaaggnagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtnttaatgtnt

SEQ ID NO: 33751 - DNA, 441 bp, Homo sapiens
ggggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttct

SEQ ID NO: 33752 - DNA, 304 bp, Homo sapiens
aacaaccaaataaccttttgtggtcctgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaatgccaatg

SEQ ID NO: 33753 - DNA, 372 bp, Homo sapiens
attctcaatgtcttaagaacgttcctaattctggagaggatgtcaaaatatcaacatgaacaggagtttggaagaagtttgttctgtccctcatggatgcctttgaggggttcaagacttctatggaggaggggactgtagaagtagtggaaatagcaagagaactagaatgtgaagtggagcctgccaggtgtgttggctcatacctgtaatcacggcactttggaaggttcgggcaggaggatcccttgagcctaggaattgcaggcagcagtgagctatgttcgtgccactcccctcactccagcctgggtgacaaaagcgagactccatctcaatttaaaaagaaaaaaagaggtggagcatgaacac

SEQ ID NO: 33754 - DNA, 338 bp, Homo sapiens
cattgttagggaacatctcattcccaggagtatgcatcctgtacgagccaagcccacgagctttttgaatgattaagtcagccctattggcatagagaagtagcagttgctcagttttttcagtccagaggtatgaaatgtttggataagattcagaattggagagacagcttctgaacgctatagccaggagttacatgtacaatgggcatagtgtggaaagcactattaaagcacatctgtctcagcaggcccacccagccatcatcagaagtgggaggcaggaattctcgtggtatggtagaggaaggatttgaggtagacaagaggaacaaggg

SEQ ID NO: 33755 - DNA, 291 bp, Homo sapiens
agttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggtttttttgttgttgtttttgctttgtttccttttttagaaagttctagaaaataggaaaacgaaaaatttcattgagatgagtagtgcatttaattat

SEQ ID NO: 33756 - DNA, 276 bp, Homo sapiens
tgcagtggctcatgcctataatgccatcactttgggaggctgaggtgggaggatcacttgaggtccggcattcgagaccagcctggccaacatggtgaaacccatctctactgaaaatgcaaaaattggccaggcatggtggcggatgcctgtaatcccagctactcaggaggctgaggctggagaattgcttgagcctaggaggcggaggttgcagtgagccgagattgcgccactgcactccagcctgggcgacagagtgagactccatctcac

SEQ ID NO: 33757 - DNA, 416 bp, Homo sapiens
  misc_feature 19: n = A,T,C or G
gatgaccgcgacttcgagnccctccctaggcccagtgtgccccttccgctgtcaatgccatcttcgagtggtccagtgttctgatttgggtctggacaaagtgccaaaggatcttccccctgacacaactctgctagacctgcaaaacaacaaaataactgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatag

SEQ ID NO: 33758 - DNA, 472 bp, Homo sapiens
catatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcataca

SEQ ID NO: 33759 - DNA, 435 bp, Homo sapiens
atttgactgaagttcttccctatgcacttattgtcagttcttgagatgatgctctggacttaataactttgatcagaccttctaaacccaaatttgaagtgaggaccagaccagaaaatctaggatacatgatggctagagacacaggtgtagcttttaatagatgcaggctaacagctgccattttcccattctctagatacattattctattttcatcttccccagaaccctgcaaggcagtgctttcacttcctgaaagaaactggcaggatagggaccttaccatagaacagagttctgggagaagggaactgaaccaggtcccttgcagctgtccctagacttccctgaccccatccttgcttgctttccagaccccatgccacagctggatgtgactgaggccaacaaggagttcatggaacagagtga

SEQ ID NO: 33760 - DNA, 287 bp, Homo sapiens
  misc_feature 17, 20: n = A,T,C or G
tataagaattcaacagnagnaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttcct

SEQ ID NO: 33761 - DNA, 380 bp, Homo sapiens
  misc_feature 7: n = A,T,C or G
attatcnaacatgaattgtatctgcctctcccacactaaaatatcaaccataaaaacctttgcttaatgaatgctttgttttacttgtcttatttactctgaggttctcgcggcaagacccaaatggacagtgatttggctgccagctggtgttaaaaacaagccaactccaagaaagttatgtaagtctcccaataaccaaagcaaaagttatttttctacatattagcattccaattctctaggatgccctacaatgacatttcctctctctttagggattacctctaagtgagaaaaaggaagcattagaacaacaaagaaaagaacaaaagactcaagttctccagcccccaagtaatgacttgagaagtatatta

SEQ ID NO: 33762 - DNA, 332 bp, Homo sapiens
aatccaaatatatacagcttgttttgagtttggcaataaaacacagagccagccctaagcagggctgaaaactgagtatttaaaccttaagtattctgcaatacaacaacagttaagtatatgggtcctagagtcagatagaactgaaatctaatcttgacttcaccactcagctgtagataaattactagacctcagttttcttgttcgtgaaatggggattttagttatagagtacctacttcatatggttgtcgtgaggattaaacaaaaatgtataccacagtacctgagatgtagtaaacactcttgaaacattagtcattattcat

SEQ ID NO: 33763 - DNA, 383 bp, Homo sapiens
  misc_feature 6: n = A,T,C or G
tcaganccttgatatggcttcactttcctaggcttgtaggtaacactaacacagggattattttctcctttaaagaatacaggtgcatctgtccactgcaggttgtctgtgacacagtatatttcgtaatgaccttcactctctcctccagacaaggattgtctctgatcctccttgtggaaggctggtccttgggtgggcctaggcaattcagttcttcgggaaacagaaaggctctagataaattctctgtggatcattgatcaccaaaagatctgagtcttaaagcatcttgaaagtcctgcttttattagtctatatccgggatcagcaaagtataatttgcagaccacatctggcttgctgcctgattttgtgttaat

SEQ ID NO: 33764 - DNA, 296 bp, Homo sapiens
ctgaaagacctttccctgtacttacctttcaacatgcttcaatcttatcaacgctacattttgtatttttcaaacaagtataaattctgcaataaagagatgtagtttttttttaagattgagtttttgtttgttatttatttctgaatggttcatcagtatgttaactataccttttatcgagaaggaaaatcactaagttttattcaggctctaccaacccccattatatctactgtttgtttatgtcctaaattaacctttcatcctatgaagtaataaagttcattttaaac

SEQ ID NO: 33765 - DNA, 343 bp, Homo sapiens
catcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgaga

SEQ ID NO: 33766 - DNA, 162 bp, Homo sapiens
gcgactcttagcggtggatcactcggctcgtgcgtcgatgaagaatgcagctagctgcgagaattaatgtgaattgcaggacacattgatcatcgacacttcgaacgcacttgcggccccgggttcctcccggggctacgcctgtctgagcgtcgcttgccg

SEQ ID NO: 33767 - DNA, 384 bp, Homo sapiens
agggtaaaaatatcttaaatagaaattgtctgaaatagcttaaattttggagcaagaatgcaccaaaattcttttaagaagtttgatccaggtgtttgaagggccccttttgttctacttgcaaaaatcagctaatctgtgttatgtacatgtagaccaacctctcttctgccacaccatatcatcaccactggctcaaagtttcttctactccagtccccatcccaggtatgaaattccagccctacctggcacaatcccgtatgtgctgcagcctcaagtctaggcttccactatccttacagtatctccccacctctcgaccccaaagtacagtctgaaattcttgtcctggttacatgcctcatgtctttgggttgattg

SEQ ID NO: 33768 - DNA, 388 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 33769 - DNA, 141 bp, Homo sapiens
  misc_feature 3: n = A,T,C or G
gtnagcagacagaaagtaagcttgttatcagaagttacgctgaatttatagacaggtgcatttcacagaaaaagtttggcaaagattagcttttgagcagtaattacctatggcttttgagaatggtttattcaacttgcc

SEQ ID NO: 33770 - DNA, 376 bp, Homo sapiens
  misc_feature 6: n = A,T,C or G
gagacnccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgt

SEQ ID NO: 33771 - DNA, 431 bp, Homo sapiens
  misc_feature 8: n = A,T,C or G
ggcagggnagggcaaggggaacaccagcaccagtaaggcagacagaaaagaaaaaaatgaagcagatgggaagtacacttggaaagggtgggaacagggtaggggctggctacttaaaaggcaagaggatcaaggcctcgaggagaaaaagcaaataaagaaggaaatggaatcaaatcagatgaagtccttttaggggaaggatgatgtgaacgaaacaaacaaatcaacagaatgaggaaaggcacgggtgaaaccaccagaggaaagttccagccagcacacaggagggaggaaagctcttgtttgaaatggaagctgatgctctaaaggagcattcagggtttggagcaacatttagatatgggggccactgaagcttccatttgtttactgagcacctaccacaggctgggtgctgtactaagact

SEQ ID NO: 33772 - DNA, 163 bp, Homo sapiens
aaattaagaaagttaaagtgcaataatgtttgaagacaataagtggtggtgtatcttgtttctaataagataaactttttttgtctttgctttatcttattagggagttgtatgtcagtgtataaaacatactgtgtggtataacaggcttaataaattctct

SEQ ID NO: 33773 - DNA, 288 bp, Homo sapiens
atttcaaaagtatctgaagcaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaatc

SEQ ID NO: 33774 - DNA, 318 bp, Homo sapiens
ggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatg

SEQ ID NO: 33775 - DNA, 384 bp, Homo sapiens
gactcctgaactgacagcattcgggccgagtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 33776 - DNA, 177 bp, Homo sapiens
  misc_feature 13: n = A,T,C or G
agggaacaccagnaaaacctcacaatgtgttatttaccttgatgaattttctatagcctaattgatgactgtttcttagttctgcatgtccagaaacttaattttaatagcagacagagattcagtcttttgggaatggactcatgctgagttcaaaagagaccaataagtaaaccg

SEQ ID NO: 33777 - DNA, 334 bp, Homo sapiens
  misc_feature 6, 30: n = A,T,C or G
gggaanccggcggcggccgagcggggtcanttctctgcagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggttcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggct

SEQ ID NO: 33778 - DNA, 311 bp, Homo sapiens
ctaagttatggaccgagcatggtagctcacgcctgtaatcccagcactttgggagtcagaggtgagcggattacttgatgtcagtagttcgagataagcctggtcaacatggtgagaccccatctctactaaaaatacaaaaattagccaagcatgatggcacgggattgtagtcccagctactcaggaggctaaggcagaagaattgcttgaatgcaggagaattgcttgaacccaggaggcagaggttgcagtgagccgagatcgcaccactgtactccagcctgggcaacagagtgagactctatctc

SEQ ID NO: 33779 - DNA, 100 bp, Homo sapiens
  misc_feature 16, 20, 33, 34, 36, 37, 38, 46, 54, 55, 59, 60, 61, 63, 65,66, 68, 70, 71, 73, 78, 81, 84, 93, 98: n = A,T,C or G
atgcacttcactagcntgancaaggggatccannannntatgcaangcatgccnngcannnancnngnanncntggcncgnatnatggaagangagcnag

SEQ ID NO: 33780 - DNA, 128 bp, Homo sapiens
  misc_feature 10, 20, 29, 30, 35, 49, 92: n = A,T,C or G
tcctagtaanctggtttacnctgaaagannaagangcctcccctgttcnctgaaataccaccttgatgttcaagtatttaagaccctatgcnaatattttttaccttttctaataaaccatgtttgtt

SEQ ID NO: 33781 - DNA, 314 bp, Homo sapiens
  misc_feature 3: n = A,T,C or G
gancgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttt

SEQ ID NO: 33782 - DNA, 500 bp, Homo sapiens
  misc_feature 2, 49, 118: n = A,T,C or G
cncccgggaactttcggcatttttggccggggaaggtgctgtgtaatcnttaaggagccggaggcttttggagcctgctaaaatgccggattaccctcggtgccgatcagcggaaganccaaagaggatgagaaggacgacaagccccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtgggtggaccttagtgatcaaggtggcacctactgacattgaagaaaggat

SEQ ID NO: 33783 - DNA, 278 bp, Homo sapiens
  misc_feature 6, 241: n = A,T,C or G
gctttnacattcgggaagcgtcgggattaggtgaaagaagctgagctgaacacattgcgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggnccgggataattaaataaaatgcttaattcatgtggct

SEQ ID NO: 33784 - DNA, 351 bp, Homo sapiens
  misc_feature 8, 9: n = A,T,C or G
tccggccnntttatgggcccggggcctttcctgttgatgttaacctgagcctacctagagatattcttatttcacctaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatt

SEQ ID NO: 33785 - DNA, 350 bp, Homo sapiens
  misc_feature 17, 42, 48, 54, 57, 60, 65, 91, 134: n = A,T,C or G
cctccgatctcagagcnaagtctcgggatcacctcagatgcnagcccnaagaanacnacnaggcnctgaaaaggggaccatcatagggacnaggcgtgaacgatctcgctcctttgagaggtcccataaaagcnagcaccatggtggcagtcgctcaggacatggcaggcacaggccgcctgactttctcttcctttgagccctgcatcagttcttggttttgcctatctacagtgtgatgtatggactcaatcaaaaacattaaacgcaaactgattaggattttgatttcttgaaaccctctaggtctctagaacactgaggacagtttcttttgaaaagaactatgt

SEQ ID NO: 33786 - DNA, 500 bp, Homo sapiens
  misc_feature 2, 6: n = A,T,C or G
cncccngggaattcggcattaccggccgggatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacgcactggggaatggagcaaaacagtctttgaatatcgaacacgcaaggctgtgagactacctattgtagatattgcaccctatgacattgggtggtc

SEQ ID NO: 33787 - DNA, 449 bp, Homo sapiens
  misc_feature 1, 15, 35, 39, 53, 58, 70, 72, 73, 86, 105, 119, 138, 187,252: n = A,T,C or G
nttgggccgggaaantccatgagatggctggaacnttcnaccaatgacctgcnagccnagcctttggttnannagaaaagggcccnagttctttcttccacgaanaaccgcccctaccnccacattcgcacaaacccnaaccgctttcaaaaaagttgaaatgaaattgggctattgaatgttttgnccctcctcagcccatattcaccctgacctttcacccaacctggctattttcaccttctttaagcncctcgacaacctttttgcagggaaaacgctcccacagcccagcaggatgccagaaaatgcttttcaagagtttgttgaatacccgaagtatgggatttttttatgctacgggaataaacaaacatttctcattggcaaaatatgttgattgtaaatgggtcctattttgattaataaagatatggtttgagcctagc

SEQ ID NO: 33788 - DNA, 394 bp, Homo sapiens
  misc_feature 9, 11, 34: n = A,T,C or G
ctccggccntntattggcccgggatgagtaaacngaaatgtatccagaagaagagtggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagaatttggttgccttttaggtgagccaatggtggcagcagaagtaggcgtatgggataactattgtgtaaagaaacagcttcttcactcctggtaagtttgggaaaatgaaaactaaactgttagagaatcatacttttttcat

SEQ ID NO: 33789 - DNA, 187 bp, Homo sapiens
  misc_feature 5, 6, 10, 21, 29, 31, 32, 38, 47, 54, 60, 61, 64, 71, 74,75, 94, 137, 139, 144, 172, 181: n = A,T,C or G
aaganncgcnagcctaagccntgccgaanannttaaantggtggaantttggcnagggannacnattggantcnntccgacaactttccgaaangccacctttgccgggccccccggggtttcccttccccgggggncntaccncccctgtccttgaagccgtccgctttgncccgaatcnaatccg

SEQ ID NO: 33790 - DNA, 157 bp, Homo sapiens
  misc_feature 5, 24, 147: n = A,T,C or G
ggtgnagtcattggcctcacttgnagcgtctgccttcctggactcaaaagaatcctcctaccttcagccctcccaaagtagctaggaccacagagttgtgctctcctgcagcgttttgcggacggctggctatcttacccagaatcnaatcacactg

SEQ ID NO: 33791 - DNA, 435 bp, Homo sapiens
  misc_feature 5, 17, 30, 31: n = A,T,C or G
gtgancttgttcttccntggtgggagagannctggaaggaaggagcccagccgtgccaaataatgaaaggagcaccgggggcaccccttcagtagcacccggaatcagcggtggtagccggtgacctctgctatggacagccctgcagcccgctccagccctaactacatgccctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatggggggaagatccccatctccta

SEQ ID NO: 33792 - DNA, 312 bp, Homo sapiens
  misc_feature 3, 8, 11, 12, 13, 14, 23, 30, 32, 35, 38, 44, 60, 64, 82,107, 137, 224, 227, 256: n = A,T,C or G
tantgganacnnnntgctcaganagactgncnagnccngtcaancaccagattgtttgcnaagnggaggcatcaggtgtccntggcaggctgatttctaggtagganatgtggtacccctcacttttaatgaacaantggcctttattaaaaactgagtgactctatatagctgatcagttttttcaccctggaagcatttgtttctactttgatatgacctgnttntcggacagtttatttgttggagaagtgtnaccaaaagttacatgtttgcacctttctagttgaaaataaagtgtatattttttgc

SEQ ID NO: 33793 - DNA, 210 bp, Homo sapiens
ccatagccgaccacccataagaaaaattccttgccattaaaaaataaaccttagaaatggttacctgttttgtggtcctgggtgtgccctatttttaccttcttatggacaccatatttttattatagaacaaaaacaccctgcttattatgctcttaaattaacccttttaatgctgaacttcttttattacacagttttatttgcttt

SEQ ID NO: 33794 - DNA, 415 bp, Homo sapiens
  misc_feature 6, 10, 34, 38, 42, 49, 57, 67, 70, 88, 95, 167, 186, 219,382: n = A,T,C or G
cggccnatcnatgggcccgggggcttttttcccnggtnggcnggcttgntggtggangtgtcctctnagnggtgataccgtggggtgnagaaaangtcctgggtcccgcgcccagagccccagccgcgccctcgtccgccattgccctcggaaaattgaggaaatcnaaggacttccctgctcacnagccccgacgaaaagggatgccaaatcctgtcnaagatccaagaaaaaataaggacaaccgtgaaagtttaaagttcgatgccagccagataccctttacaccctggtcatcacctgacaaagagaaggcagagaaactgaagccagtccctgcccccccggtttggcagtgaaaggaactgaaatgaacccaganacacctgattggaactgtattatatttaaaatt

SEQ ID NO: 33795 - DNA, 313 bp, Homo sapiens
caaagccctacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatgtagaaagcctgcctgaataatagaatctagaacaacaacaaaaatattaattttttctgtgtatgcttaggtcaagc

SEQ ID NO: 33796 - DNA, 149 bp, Homo sapiens
  misc_feature 17, 19, 73: n = A,T,C or G
gcgatgatgtggctctngnaaggcgtgagccacttcttccgcgaattggccgaggagaagcgcgagggctacnagcgtctcctgaagatgcaaaaccagcgtggcggccgcgctctcttccaggacatcaagaagccagctgaagatga

SEQ ID NO: 33797 - DNA, 459 bp, Homo sapiens
  misc_feature 2, 15, 28, 32, 39, 41, 42, 50, 53, 57, 84, 143, 171, 338,402, 453, 456: n = A,T,C or G
tnggccccgggattntcttacctggganctcngtcttcnannttgttccngancctntgaagtacccctggcccttcttgggcnagtgtgaccgtttcctggctggcaatccggatgcctggcccagccaggccagtcaaganaaccagccaccattagttcccagaaganagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggngagctcagatagtctctttctctgacactgtgtaagaagctgtgaatattcctaacttacccanatgttgcttttgaaaagttgaaatgtgtaaattgtttttggaataaaaganggnaac

SEQ ID NO: 33798 - DNA, 417 bp, Homo sapiens
  misc_feature 19, 34, 38, 39, 55, 56, 64, 82, 96, 102, 118, 160, 203: n = A,T,C or G
tcccctgggacttccggcntcttggccgggggtngtgnnagttgtagcccccgannggtgtgangggaatgggaccagatantaaaattggaaganataacngcctctgaatttttcnaaaagtaaaaaccgatattccaatctaccaacctttaagaantcctcccattattattccctaagccaaaataaattattaaganacctccaccacccccagaccatttgccagccaaaaaccttcagaccaaccaattaggaccagagaccaaaaatcttaaagccctcagaaaagaagccagttacctttcaaaggaagaaccagttagacctgagaacctgacttctcaatagtaaccaaaggaagccagcgagcaatggaagggttttcaattaacacctgaagtttgataaggc

SEQ ID NO: 33799 - DNA, 471 bp, Homo sapiens
  misc_feature 367: n = A,T,C or G
catgttgtcaacacttctttatggaaagaatgatctctttgaggataatgcattgcaaaatgaaaaatctctcatgttcatgtttatggacaacctccttttttggcttcactaaatatttgcttagaaaacaaaatcaaatttctttgcattgatttaagcctaaacctgaagcaaattgtagttagggactatatacaggactatatgtcatcctagccattccatctttataccattagaggacttagaagcactaaagtcgaaggctctgccattcctattttcttgtgttaaggatttacaggatgacattcagaatcgtgccacctcatttgccactgttgtcaaggacattgaggggttnttgggaagagaatcagaccaagctgagcccacgtgagttgacagctcttcgggaaaagcttcatcaggctaaggagcaatatgaggcgctccaggaagagacac

SEQ ID NO: 33800 - DNA, 326 bp, Homo sapiens
  misc_feature 11, 19, 323, 324: n = A,T,C or G
gggccgggganctggttcntgtctgaaaatttacctcccggctgagttttttttaataacctccctcaaaaataaattgcttattaccatttacctttcccagaagacagccctcttacccaacctggcttagaaaccgttttacagaaaaggactagccatgccttgctgagactttttatgtagtataactagaacagagttggaatgtataataatgtaatgcaaattgattttaacaaatataattcttgagattctggtatgtgcaagatatatgggaatatgaagtagagtataaatatagatagaatataaacgtnngc

SEQ ID NO: 33801 - DNA, 471 bp, Homo sapiens
  misc_feature 415, 418: n = A,T,C or G
caaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatgggagtgggatgggatccacctgctctttttttatttacctcagtgaaggttgaaaattnggngtcctcatttaccttggagagcaaaaaatccctacgaagaagctgatcataat

SEQ ID NO: 33802 - DNA, 415 bp, Homo sapiens
  misc_feature 384, 403: n = A,T,C or G
ggagcctgctggcccgggacttcgagaagaactataacatgtacatcttccctgtacactggcagttcggccagctggaccagcaccccattgacgggtaccctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatgggtttggtggtcctgcctggagacaaggngctaacatagatttaaagngaatacattaac

SEQ ID NO: 33803 - DNA, 312 bp, Homo sapiens
  misc_feature 3, 16, 38: n = A,T,C or G
ccngggaattcggcanttatggcccggggtaaatagtncatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctcctttt

SEQ ID NO: 33804 - DNA, 469 bp, Homo sapiens
ggaggagctccgttatgcaccccctgtctttccgaaaccccatgatgtctaagcttcgaaactacccggaaggaccttgctaaactccatcgggaggtgagaagcaccaccctttgacagcccaccaccctggaggcccgaggagacatgaaatatggcatatatgcctgtagagaatgagcatatgaatcggctacagtctcaaagggcaatgcttctgcagggcactgaaagccctgaacccgggcccaccccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttact

SEQ ID NO: 33805 - DNA, 183 bp, Homo sapiens
  misc_feature 19, 43: n = A,T,C or G
ccccgggaatttccggccntttatggcccggggagttggaacnaataaaagggtaaaaagatagtctatttaaaacaagagtgtccaatcttttggcttccctgggctacagtggaagaagaattgtgttgggccatacataatgtacgctaaggatagccaatgagctaaaaaagaattgcg

SEQ ID NO: 33806 - DNA, 442 bp, Homo sapiens
  misc_feature 8, 15, 29, 43: n = A,T,C or G
tacccccnggggaanttccggccatttantgggccggggtatnaaatgtattattattacctgtattaaacgtatgtatacctgtataaatgtacctgatttgtgaccgtaaacctctgtttcttacctgtggaatttgctaaaaagccgtttaagaaacacctagccttttagtgtagaagcccagcataccttgctggttgcagtaatccagggaactttaaggaaggatggcaggctagagttgggtcccaaggcatgggtagaatttggatgctgcagaagaggggcatggggtgagcagttcccaagaccatcctccctctgacatcaactgcaggtttggcacgttccccaagtcaccttcaggttcgataatgcataggactgcagagctcactgaaggctattatactcacggttacaatttattacagggaac

SEQ ID NO: 33807 - DNA, 496 bp, Homo sapiens
  misc_feature 3, 16, 45, 53, 55: n = A,T,C or G
ccngggaattcggccnttatggcccgggatttgcatttgctagcnatgaagancnaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtgggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataag

SEQ ID NO: 33808 - DNA, 214 bp, Homo sapiens
  misc_feature 3, 4, 36: n = A,T,C or G
atnnaacattgtttgtaataatcctaagctggaaanacctcccagtggcctacaaatagtaggatggataaaatatgttcctgtgtggcccgggtgtggtggctcatgccctgtagtccccagcgctttgggaggcagaggcccagtggatcacgaggtcaggaatttgagaccagcctgaccaacacggtaaaaccccgtctctaccaaaaat

SEQ ID NO: 33809 - DNA, 454 bp, Homo sapiens
  misc_feature 7, 8, 25, 436, 450: n = A,T,C or G
ccggccnntttattgggcccgggantttttatttttggctccctgtgcttttcaggtcttacctcaaggagtctttgccccaggcctaatgtcctggagtgtttcccccattgttttcttctagaatatgaggatggttcagcatacgccaaattattaaacataatatgtcacgtcaacagagtgaagaccaaaacccatatggtcatctcaatagatgccaaaaaaacattcagtaaaattcaacacaatgaaaacttcgtgataaaaactgtcaacaaactaggtatagaaggaacatacctcaagacagtaagggccatatatgacagacatgcagctggtatactgaatggggaaaaaaactgaaagcctttcctctaagatctgaaacaagacaaggatgcccactttcacaacttttgttcaacataancctgggaagtcttnaagt

SEQ ID NO: 33810 - DNA, 254 bp, Homo sapiens
  misc_feature 30, 55, 70, 71, 95, 159, 178: n = A,T,C or G
cgggaaatctttgggagggaagccaagaanccagccaaaaggggtggatgcctgnctccagccagggtcnnccccttcaaggggccccaaagaangttattttttccccattccccccgtgggaagcaccttggagggaagggaagattcccgttatcnagattcccgcccgaccganctgcaagccagtttcggggagggagttcaaacctcatttgcccatctggacacatacaaggaaccttttgaactgg

SEQ ID NO: 33811 - DNA, 393 bp, Homo sapiens
  misc_feature 14, 15, 63, 64, 67, 72, 87, 100, 106, 151: n = A,T,C or G
tacccccggggaanntccggccaatttaatgggcccgggcttttattccctgatggtagagannganctccnggcagccccctggancttgctagccccnaaaganggaggatgtggttaatctgtttcaccctggtttgtcctaaggccntagttaaaaagtacccagctctggctggggtccgtgaagcccaggccaggcagccaaatcttgcctgtgctgggcatacaaccctctgctttcacatctctgagctatatcctcattagtgaaggtggcttttgctttatagtttggctgggggagcacttaattcttcccatttcaaaaggtaatgttgcctggggcttaacccacctgccctttgggcaaggttgggacaaaagccatct

SEQ ID NO: 33812 - DNA, 123 bp, Homo sapiens
  misc_feature 7, 8, 9, 19, 24, 25, 29, 33, 34, 40, 41, 49, 58, 102: n = A,T,C or G
accaacnnncgttttccanttganngtgnaganngggganntcctgganccgggcccntccgtatcctctgaccaccgatgggccgccttaccttttcagancttcattaaaccttatgaccc

SEQ ID NO: 33813 - DNA, 470 bp, Homo sapiens
  misc_feature 304: n = A,T,C or G
gctctcttcctaagcccggcgctcggcaagttctcccaggagaaagccatgttcagttcgagccgccaagatcgtgaagcccaatggcgagaagcccggacgagttcgagtccggcatctcccaggctcttctggagctggagatgaactcggacctcaaggcttagctcagggagctgaatattacggcagctaaggaaattgaagttggtgggtggtcggaaagctatcataatctttgttcccgttcctcaactgaaatctttccagaaaatccaagtccggctagtacgcgaattggagnaaaaagttcagtgggaagcatgtcgtctttatcgctcagaggagaattctgcctaagccaactcgaaaaagccgtacaaaaataagcaaaagcgtcccaggagccgtactctgacagctgtgcacgatgccatccttgaggacttggtcttcccaagcgaaattgt

SEQ ID NO: 33814 - DNA, 361 bp, Homo sapiens
  misc_feature 40: n = A,T,C or G
agcctcttagtcattaaccccaagttttgggattttgccnttagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagc

SEQ ID NO: 33815 - DNA, 234 bp, Homo sapiens
  misc_feature 3, 7, 10, 11, 12, 13, 19, 22, 25, 35, 61, 65, 69: n = A,T,C or G
gangcanccnnnngggaanttngangggggtagangttggggttcctttgaagttttaccncccncctntagttccccacctgaattttgtaaccttccctgtgtttgcatccctctgttcctattctgcccttgctctgtgtcatctcagtcatttgacttagaaagtgcccttcaaaaggaccctgttcactgctgcacttttcaatgaattaaaatttattttctgttcta

SEQ ID NO: 33816 - DNA, 386 bp, Homo sapiens
  misc_feature 273: n = A,T,C or G
gttgggactttaggacaggtttgtttacttaaagtaagaactgcattgtcaaagttgaaagaggaacacttttgtgagttcacaaatgtgttcttaagaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgntcatttgaatgactttgaattcaagccattataattacttttaaaattaaatatcatttgcactgttctgataatgggtgcagtttttgagcaatataatcagagctaaatat

SEQ ID NO: 33817 - DNA, 485 bp, Homo sapiens
  misc_feature 3, 16, 471, 478, 484: n = A,T,C or G
ccngggaattcggccnttatggcccgggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcagtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctgggttgtgatcgcatcatagactccaaaaagaagtttgataaatgtgggngtttgcngggggna

SEQ ID NO: 33818 - DNA, 159 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgt

SEQ ID NO: 33819 - DNA, 222 bp, Homo sapiens
  misc_feature 5: n = A,T,C or G
acccngggaattcggcattatggcccggggtgagaggtctgactcctaagtggccaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcag

SEQ ID NO: 33820 - DNA, 497 bp, Homo sapiens
  misc_feature 3, 45: n = A,T,C or G
ccngggaattcggcattatggcacggggactcgttcattaaaccnccctgagtgcagtagtgatgtcgacccttgagcctccagcagcggaacagaggggaccctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtggggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatggggcga

SEQ ID NO: 33821 - DNA, 214 bp, Homo sapiens
taattgaagctcatgcctccgaaacagttatagcaaaggagaaaccccagagcttgcaggaagaagaggccatgtgagtagagagtgagaacctcggctgcctatgagccccataccgaagaagccctcaggatgaaagcctaccctgacccaacacccttgattttggacctcttctagaacacgggaaataaatttttgttgttttataagg

SEQ ID NO: 33822 - DNA, 447 bp, Homo sapiens
  misc_feature 8, 9, 29, 36, 55, 82: n = A,T,C or G
tccggccnntttatgggccgggccgcccntgggaancctggttaaaactaacacngccctcttaggctccttccctgaaganctggattccatgggtctatgatggggctagaaatttgcatttctaacaaaactcccttgtcatcatggacgttttagagatattgatactattatttctactgatttctgctctcgggagtctgtaaactttttctgcaaatggccaactggttaacttttaaggctttgtagaaccgatagtctctctctgtctctcactactcatcaacttgatgtggtagcacaaaagcagtcagtcagcctattgctaatggtaaatggagaatttagccctaaagctgcctccttaagttcggcctgaagttttctctgtacattgtgaactataacaaatggaaaggtggaacaaggaccaatcaccga

SEQ ID NO: 33823 - DNA, 354 bp, Homo sapiens
  misc_feature 10, 11, 27, 34: n = A,T,C or G
aattccggcnnttatggcccggggacnatgaccnccctttgcagaaagtaaacctgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatct

SEQ ID NO: 33824 - DNA, 422 bp, Homo sapiens
gaaaaattataaccagcataatatagcaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaggatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 33825 - DNA, 463 bp, Homo sapiens
cggccggaaccgcctcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaacca

SEQ ID NO: 33826 - DNA, 275 bp, Homo sapiens
  misc_feature 3, 16, 36: n = A,T,C or G
ccngggaattcggccnttatggcccgggggaagccncctggcttggaaccccctggttggaacataagttctcttgggcattgccattccagggtattagggtattgaggcctgaggcccctgaggatagcatgaagccatctggggacttctccatgagaacttcttgtcactaagtgcgtgtaattgctgatttagtctagcctggcaggcccagtggttctggtaagtggtgttattataccaggctattggctggtagttggctaatttga

SEQ ID NO: 33827 - DNA, 226 bp, Homo sapiens
tcttggtctaatattaaaatgtttttgcattaccttagcatgcttactggatgggcagtgaagggagaataaagtcaccctggcacatgtgagtgtgaaagaaagctaacttaaaaaaaggagccactgcgcccagccaacaatagttcttatataacccactgcccaccctggccttcctccatccccctcgcacccacacattatatagctgtaaaatacctgc

SEQ ID NO: 33828 - DNA, 425 bp, Homo sapiens
  misc_feature 6, 12, 37: n = A,T,C or G
accccngggaanttccggccattatggcccgggattnagtgagcatctttttgtgtattttgtataccctactgcatgagatgctgtgcataacagggagtgagctaagtggccaatttcagggtttatctggggatgagaatgtagaaagttcctagaaagaggctgtggaaggcagtggcagggaaagcagtggaaccatcgttaccacaacagagcggcaagttctctgacccactcaggaaagtatttaatggtaagatgtctttggaagactagaattgttgtgttacttgaaaaccctttggctgggcatggtggctcacgcctgtaatcccagcactttgggaggcctagacgggcggatcatgaggtcaggagatgctgaccatcctggctaacacggtgaaaccctgtctctacta

SEQ ID NO: 33829 - DNA, 400 bp, Homo sapiens
gctgaagctgaaggtagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtgggattttgggcccctcatcttcatttattatattatcaaaactgagag

SEQ ID NO: 33830 - DNA, 211 bp, Homo sapiens
  misc_feature 16, 30: n = A,T,C or G
cccgggaattcggccnttatggcccgggcnccctgtcatcataactggcttctgcttgtcatccacacaacacccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 33831 - DNA, 157 bp, Homo sapiens
acatttaggatctagaagttttacttttataaagatggtgtccggaagatgttgctaatgtattttacttcaagatagggaacaaactttttaagtatattaataaacctgtatggttagtttttaacagttttttaaaataaactatggatatgac

SEQ ID NO: 33832 - DNA, 344 bp, Homo sapiens
  misc_feature 3, 18, 34, 58, 63, 89: n = A,T,C or G
ccngggaatttccggccnttatggcccgggcacnaaccgtggcagccttcctttttcngaacnagggtaaagagataaagactgagccncaatgtcatttataatctagcctcaaaagttacacacagtgttttctgtttgttgagcaaataacttctattcagtatgaaaggtgctttacagggcatgaataccagagatggggatcgttggggccatcttggagactagctaccacgttaagaataaataatacttcttaaattaagcatttttatttcatattacaccatgtcagaatgcatttaggctttactcagtagcctgcagaccggaaaatttca

SEQ ID NO: 33833 - DNA, 124 bp, Homo sapiens
aatgccccaactaaatactaccgtatggcccaccataattacccccatactccttacactattcctcatcacccaactaaaaatattaaacacaaactaccacctacctccctcaccaaagcct

SEQ ID NO: 33834 - DNA, 337 bp, Homo sapiens
gctttccaacttggaacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatact

SEQ ID NO: 33835 - DNA, 213 bp, Homo sapiens
  misc_feature 29, 177: n = A,T,C or G
gggcctgtgggacgtttctgcatttggantgaaagtgctttccggaagttagatgaattgtacggcacttggcgtaaagccgcttccctcaagagtaactacaatcttcccatgcacaagatgattaatacagatcttagcagaatctggaaaagcccagagatccaaagagccctncgagcaccacgcaagaagatccatcgcaggaggcct

SEQ ID NO: 33836 - DNA, 311 bp, Homo sapiens
  misc_feature 9, 305: n = A,T,C or G
aacagcagnaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagngaaaga

SEQ ID NO: 33837 - DNA, 353 bp, Homo sapiens
ggtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaaga

SEQ ID NO: 33838 - DNA, 392 bp, Homo sapiens
  misc_feature 56: n = A,T,C or G
gcaaagtagacaaagctttgttcatttggagcttagagtccaggaggaatacattngataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactac

SEQ ID NO: 33839 - DNA, 111 bp, Homo sapiens
ggatttccttatatctaatatatatctgggagaaaaggctgcttgaaaatatcttttgattcagtgatttttaacattgggaagttgagtttattaaaaggtagtctgaag

SEQ ID NO: 33840 - DNA, 268 bp, Homo sapiens
  misc_feature 6, 30: n = A,T,C or G
ggaacntcttatgtggttagaagtaacganatatacttttaaatatcccttggatcaaaaaaataaatcacaatggtatttagaaaatatttttcactgaaggctaacaaaacactacatattaaaattataaaatgcactttgcaaaggagtacttaatataaccttaaataaataaatatttcatatatatatatatatatatgaagaaaggctgaaaattaattagccaaacattatctgaagaagatagcaaataaacctagag

SEQ ID NO: 33841 - DNA, 103 bp, Homo sapiens
gcagctgaagaaacaaactggtctccaggctgtcttgcctttattcctggttagggcaggtggtcctagacagcagtttccagtaaaagctgaacaaaagact

SEQ ID NO: 33842 - DNA, 230 bp, Homo sapiens
gttttaggaaaggttgttctgatatcaggataaagtaggtattaaagagaaaaactgtagtcaggggagccagtcaagaggctgttaatacagtacagaatatacagtgataagactggaatcttggagtacttttgacattttagggtaggtggagaaaaagaagaaaacactagaagagactaggaaaagaggtgggagaagaactaggagtaaagatcatagtggcg

SEQ ID NO: 33843 - DNA, 159 bp, Homo sapiens
  misc_feature 7, 26, 27, 28: n = A,T,C or G
atttttntcccccagggactctcggnnnttatggcccgggagggaaattagaagataaaaacatacttttagaagaaaaaagataaatttaaacctgaaaagtaggaagcagaagaaaaaagacaagctaggaaacaaaaagctaagggcaaaatgtac

SEQ ID NO: 33844 - DNA, 353 bp, Homo sapiens
  misc_feature 2, 11, 38, 47: n = A,T,C or G
antctcggctnttatggcccgggggcctgtttcagccnggaaggccnaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 33845 - DNA, 299 bp, Homo sapiens
  misc_feature 28, 32: n = A,T,C or G
catatacaccatcagcagactctaattntttnatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttg

SEQ ID NO: 33846 - DNA, 389 bp, Homo sapiens
gagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaag

SEQ ID NO: 33847 - DNA, 353 bp, Homo sapiens
  misc_feature 352: n = A,T,C or G
atggcccgggcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacnt

SEQ ID NO: 33848 - DNA, 363 bp, Homo sapiens
  misc_feature 15: n = A,T,C or G
caaagatttcaagcngggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagaga

SEQ ID NO: 33849 - DNA, 113 bp, Homo sapiens
gacggggaatcagggttcgattccggagtagggagcctgagaaacggctaccacatccaaggaaggcagcaggcgcgcaaattacccactcccgacccggggaggtagtgacg

SEQ ID NO: 33850 - DNA, 467 bp, Homo sapiens
  misc_feature 12: n = A,T,C or G
gaaaagcatggnaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccat

SEQ ID NO: 33851 - DNA, 332 bp, Homo sapiens
caagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcacgtaataccaagaattgttactttacaatgttcccttaagcaaaattgaatttgctttgaacttttagttatgcacagactgataataaacctctaaacctgcccagcggaagtgtgttttttttttaaatttaaatacagaaac

SEQ ID NO: 33852 - DNA, 162 bp, Homo sapiens
  misc_feature 2, 17: n = A,T,C or G
cngggaaaactcggccnttatggcccgggcatttttataagtataccgtaaaaaccgcattacatgtattgatagtgttatatagtctgacatgctttgtctagaaaacaattagtatagtatggattcttaccacttaaaaattactctgtactttgcttt

SEQ ID NO: 33853 - DNA, 298 bp, Homo sapiens
taaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacact

SEQ ID NO: 33854 - DNA, 210 bp, Homo sapiens
ggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatga

SEQ ID NO: 33855 - DNA, 423 bp, Homo sapiens
  misc_feature 6, 8, 26, 33: n = A,T,C or G
gctaangnaaaaaaaattatcttagnaatagtntatccagtgaaagtatcattcaaacataaaggaaaataaacactttcccagacaaacaaaaactgagaaacttcgtcaataccagacctgtcctataagaaatgctaaagggagtttttcaatctgaaagaaaatgacattaccaagcaataagaaatcacctgatggcacaagactcactagtaacagtaagtacaaagagaaatacataatgctctaacactatgattgtcatgtgtaaaccactcatgttatcttgagtaggaagattaaaatacaatcctatcaacaataataactgtaacaactttttaagagatagtctaaaaaggtatacattggaaacaataaaaagtggtcagggatggagttttaatgtagagttcttat

SEQ ID NO: 33856 - DNA, 389 bp, Homo sapiens
cttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttga

SEQ ID NO: 33857 - DNA, 431 bp, Homo sapiens
  misc_feature 11, 33: n = A,T,C or G
gttttccaagnaacttgacaaattgtttctaanattcatgtagaagcagaaagagtcaagaagagttaaaagccttctaaaggaaaagaacataatgggggacttagtgtaacaaataagatttcataagaaatcttagtgtaacaagatttcttatgaaattatgtaactaattcagtggggtatatcatgttagctcaggggtggacaaatttccagtgaaacaagatatagagcctagaaagaagcctatccatatctgaagacctggcttatgacagagctggagatgatgctgagtggaaagaaaatgaacttcacagtacttggctctggagcaaatggttatccacgtggaaaaacatgaaaccaggctcccaccacatgtcttgcacaggaatcagttccaagggattaaataattaaagatg

SEQ ID NO: 33858 - DNA, 409 bp, Homo sapiens
catctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagacatgatcactgaggccagccagacaccgaaggagccaacaaaagaagatgttaaacttcataga

SEQ ID NO: 33859 - DNA, 427 bp, Homo sapiens
  misc_feature 32, 350: n = A,T,C or G
gagtataaagggagcagggaaggcgggagacngcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcanggaaatgcatcaaaagacttaaaggtaaagcgtattacccctcgtcacttgcaacttgctattcgtggagatgaaga

SEQ ID NO: 33860 - DNA, 316 bp, Homo sapiens
ctatgtagatacacctaatgtttctataacaaatgtttaaatattcacacaaaaaggaataaaacataaatatcatcatattcattcaagtcagattttgctgccaaaacttaatgagaaaactttagccttccaaagctgtttagatttcagaattgcaataaattccagtattagaacaaagaaattatttcttcatatttgagttttcagttaaaatactaaaaaggattggaggactctggatgtatctgcacattttccctttaaaataatcttctcttctgaactttatttttcctcttttggaaaatat

SEQ ID NO: 33861 - DNA, 381 bp, Homo sapiens
ggctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcgggagaagtgcagctgctgtgcctgatgtgggaacagctcttctcccatatgtaaatagaacaacctgcacaacctggatttttttaagaatacaacactgagccatttgctgcatttctttttatactaaatatgtgactgacaataaaaac

SEQ ID NO: 33862 - DNA, 207 bp, Homo sapiens
  misc_feature 3: n = A,T,C or G
atncgaaaacaattaaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgc

SEQ ID NO: 33863 - DNA, 242 bp, Homo sapiens
gcggggcccgaacgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattattc

SEQ ID NO: 33864 - DNA, 233 bp, Homo sapiens
caccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacattttcacatgttatccttcacatatttctcattttcatctagtactttcttaatgcctttgttggagtccgcatcctcatct

SEQ ID NO: 33865 - DNA, 406 bp, Homo sapiens
gaggaagatctttgcaggaaaatcagagttgtctctcttttttaacatattgtttgagatgattattggacaccagagttgagatgccaagtgggcataatgagtttagagctcaggagaggtctgagatagttattcacattttgggataatcagcatgcatggaatttaaagtcaaagggttggatgagaacactaagatagtgagtcctgataagctgggccctgaagactccaaaagtataaggtcaagaaaaagaggaaaaacagcaaggaagactgaagagagaccagcagggtaggaaggaaaccaagagagtgcaatgtgcttgaagccaaatgtgtaaaggaaggtgttcagctgtgtcacagggtgctcacatgtcagttagtatgaggtctgaga

SEQ ID NO: 33866 - DNA, 341 bp, Homo sapiens
  misc_feature 17, 21: n = A,T,C or G
atttgaaaacagctagnaagnaataagaatattcccaacacaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggtttttttgttttgttttgttttaccattg

SEQ ID NO: 33867 - DNA, 409 bp, Homo sapiens
ccaagatggcgccgaagcgaagtaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtgggatgttaaagccaacaagcaccagattaaacaggctgtgaagaagctgtatgacatttgatgtggccaaggtcaacaccctgattcggcctgatggagagaag

SEQ ID NO: 33868 - DNA, 470 bp, Homo sapiens
  misc_feature 31: n = A,T,C or G
aacaattgaaatggtctttatgaacaggatnaaaggataacaatataaaataaaactaagtaaagaggtccttcagaaatgaaagagaaataaagacagaaaaacagaagagaacaaaaactgagagagtttatgaccactagactgccttacaataaatgctaagggaagttctccaagctgaaataaaaagctgccaatttgtaacatgaagagaccctgaatagctaaagcaatcttgatcaagaagaacaaagctggagacatcatacttcctgatttcaaattatattacaaagctacagtggtcaaaacagtatgttactggcataaaaacacatagaccaacaaaagagaacagaaagcccagaagtaaacccacacttgtacaatcatttaatcttcgatgcatgtgccaagagtatacaatggggaaatgaaaatggtcttgggaaagctagatatctact

SEQ ID NO: 33869 - DNA, 328 bp, Homo sapiens
atagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagttggttgtccaagatagaatcttagttcaactttaaatttgcccacagaaccctctaaatccccttgtaaatttaactgttagtccaaagaggaacagctctttggacactaggaaaaaaccttgtagagagagc

SEQ ID NO: 33870 - DNA, 109 bp, Homo sapiens
  misc_feature 25, 31: n = A,T,C or G
ggggaatcagggttcgattccggangagggngcctgagaaacggctaccacatccaaggaaggcagcaggcgcgcaaattacccactcccgacccggggaggtagtgac

SEQ ID NO: 33871 - DNA, 102 bp, Homo sapiens
  misc_feature 7: n = A,T,C or G
aaggatnaggggaggataacatttttgctttcttatgtgactctctttgaaaatgtgcagtaagaaattcctcaaaaataaaatttttacccttcagagggc

SEQ ID NO: 33872 - DNA, 462 bp, Homo sapiens
  misc_feature 13, 20, 29: n = A,T,C or G
caggatatcaagnaaaccgnactgcgatnactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcgaataaagaaatttggta

SEQ ID NO: 33873 - DNA, 395 bp, Homo sapiens
atatttgttggagaaagatactctaaatggagacaaacataaaatgcttgtggaaatatttagacatttaacataaacaattagaattgacattgccctccatttgacagaattttatctgaatttacattacaacagcactagaagagaatattttccctattaaaaagattatggtctatagaaaaagaaccaactgaaaatgcaattaaccataatttgaaacttgaagacaatttcaggcatttttatgggaaaaaacactaaatttttaaacaaaatactattaataaagagaattagagaaattatataagcacacaagtattgttacctgcttttaaaatttttaatgttcaggtaatgatataaagggaggtttatttattaaaatg

SEQ ID NO: 33874 - DNA, 384 bp, Homo sapiens
  misc_feature 370, 374: n = A,T,C or G
attgtttattttttaaaaagtacttaatggaggagggagcccctgtcctcagaaagcctgcagcctgaggacgagacaggacagaggcaggaggatcacgaggtcaagagatcgagaccatcctagccacatggtgaaaccccatctctactaaaaatacaaaaatcaactgggtgtagtggcacgtacctgtagtcccagctgctctggaggcagaggcaggagaatcacttgaatccgggaggcagaggttgccatgagccgagattgcaccactgcacttcagcctggtgacagagcgagactccctctcaaaaaaaaaaaagttcaaacataaaaaggctgggcgcaatggctcacgcctgtaatntcancactttggga

SEQ ID NO: 33875 - DNA, 377 bp, Homo sapiens; identical to SEQ ID NO: 32439

SEQ ID NO: 33876 - DNA, 387 bp, Homo sapiens
atcccttttcacacttaacactgttccctcctgctaattctccccacttgtttctgatcagtcaacctaagtgaaacatattggcctccttaagaattactggcctggccgggcactgtgactcacgcctgtaatcccagtactttgggagtctgaggtgggtgggtcacctgaggtcaggagttcaagaccagcctggccaacatggtgaaaccccatctctactaaaaatacaaaacttagccgggtgtggcggcgtgcacctgtagtcccagctactcaggaggctgagacaggagaatcccttgaatctgggaggcagaagttgcagtgagccgagattacaccactgcactccaacctgggtgacagagtaaagctctgcct

SEQ ID NO: 33877 - DNA, 470 bp, Homo sapiens
ggcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgaccttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaac

SEQ ID NO: 33878 - DNA, 342 bp, Homo sapiens
atttgccaacccatataataatactgtagaaacagcttattgttttagtgctaagtagagtgacaggagtttgcatgctggttgtccaatcaaaaatgaattctcaaaacagtccctcacattttattaattggaaaatcaaaaccagtatctactgggacagcaccaactaaactttctggtggaggttatctttgtagagtttgtatttacttccagatcttttctattgaaatggctctttcacagtcatttatttgccattgactgttgttccctggcaattaattaagaagagggggatagagttcacttctattaggttccctgtccctaccccat

SEQ ID NO: 33879 - DNA, 489 bp, Homo sapiens
caaagcatttgacgaaatccgcatcactttatgattaaaactctcagcaaaatcagcatacaagggacatacctgaatgtaataaaagcaatctataacaacctatctataacaaccacacagccaacataatactggattggagaaaagttgaaaatattccctctgaaaactggaactagaaaaggatgcccactctcaccacttctgatcaacatagtactggaagtcctagccagagcaatcagacaagagaaagaaagggcatccaaattggtaaagaggatgtcaaattgttgctgtttgctgatgatatgattgtatacctagaaaaccctaaagactcctccaaaaagctcctagaactgataaaagaattcagcaaagtttcaggatacaaaattaatgtacacaaatcagtagctctcctgtacaccagcagcgaccaagctgagaattaaatcaagaactcaactccttctacaatag

SEQ ID NO: 33880 - DNA, 378 bp, Homo sapiens
tagtcgtgaagctggagctccttgacctaatagttcctacacttctgcaaaccttccaagggtatcagctggaagggataggtcattgttgccaacggtggccagaaggtgcaagaagccttggcgcagcagactgcctgacactccacatgcccttctgactcagtcccaaaccagcaaaactgctaaacggaactccatgcagctattggtgcacaattggcaaaataaactgtgcaatacaggtgccaaatcaaaatgtgtataaaaaatacactggattaattctaggttaactcatgtagaaagggttcaaagtctgcaaaggatggagaaacaggagtaattctctgtgttaaaagacaaatatttgcatga

SEQ ID NO: 33881 - DNA, 327 bp, Homo sapiens
gacacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttt

SEQ ID NO: 33882 - DNA, 413 bp, Homo sapiens
  misc_feature 15: n = A,T,C or G
gaaaaatttccaagncctcttttatttctctcctcaccaaagcacaactagagcagcttgggaaagtttatgtcctgccttgcaaagcagagatgtacctgaacaaatttcaatctattccaccaggagtttgtgattgttctttcagatggcatcttctaagtctcatcttaagtttgccatttagctctccatgctttgtgacttcattttcttttttgagagcagggagaatacgttcacttttctttcattaaagagtatttcaactgtaaatgataaatggctttcaggatcctgaatataaagagctatatgaaaacacggctaaactaaaccatgagttatctggaacactggttttcaactgggactgattttgcccatcagagacgtttggcagtgcctggaga

SEQ ID NO: 33883 - DNA, 222 bp, Homo sapiens
  misc_feature 32: n = A,T,C or G
ggtcgcaggcaattgtaatcctagcttctcangaggctgagacatgagaatcacttgagcctggaagacagagattgcagtgagccaagatcatgccactgcactccagcctgggtgactgagcaagactctgtcaaaaacaaaacaaaatttaaaactgtacagtgtacaaaaatcgacagtacttccaaaatataaagaaaaaaaaagttacaaattctg

SEQ ID NO: 33884 - DNA, 460 bp, Homo sapiens
ggaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtatcgcctctattct

SEQ ID NO: 33885 - DNA, 374 bp, Homo sapiens
  misc_feature 31: n = A,T,C or G
ggatcggtggctccatcctggcctcactgtncaccttccagcagatgtggattagcaagcaggagtacgacgagtcgggcccccccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggttggcaaga

SEQ ID NO: 33886 - DNA, 388 bp, Homo sapiens
  misc_feature 30, 31: n = A,T,C or G
gacctgatgtgggaggagacagccaacctnnggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaagga

SEQ ID NO: 33887 - DNA, 257 bp, Homo sapiens
caacgtgcgatccatgcccatccgaaagatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagc

SEQ ID NO: 33888 - DNA, 350 bp, Homo sapiens
ctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctattttttttctttttaaactggttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaaga

SEQ ID NO: 33889 - DNA, 148 bp, Homo sapiens
aaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttattt

SEQ ID NO: 33890 - DNA, 424 bp, Homo sapiens
gaatcccgtaggagcctctctccctactgctgctacacaagcaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctg

SEQ ID NO: 33891 - DNA, 168 bp, Homo sapiens
cactaagaatgtttgcctcgctctaaatcattgttttcctagttgctggcctgggtattttcctccctttgagaatgttgtcctgtctgcggataaaacaggaacctgacaaatcatcttcttgttataggtttttcacttgaaatggaagaagagagtgtacatttg

SEQ ID NO: 33892 - DNA, 293 bp, Homo sapiens
  misc_feature 207, 209, 213, 254, 255, 258: n = A,T,C or G
gagcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgngnagcngcggggggcctagccctactagtctcaatctccaacacatnnggnctagactacgtacataacctaaacctactccaatg

SEQ ID NO: 33893 - DNA, 179 bp, Homo sapiens
  misc_feature 6, 102: n = A,T,C or G
ggggancagcattggacattaatagggccttttcagacccattttttaaagtgctagaaaatgctttttttaaaaaaaaaaatacaagttttaaaatgaccncttactctttaattatttactaattgctagggtactcaggggggaaaagactacagattacacactcttttcattca

SEQ ID NO: 33894 - DNA, 137 bp, Homo sapiens
ataagtaacatgaaaacattctcctccgcataagcctgcgtcagattaaaacactgaactgacaattaacagcccaatatctacaatcaaccaacaagtcattattaccctcactgtcaacccaacacaggcgtgct

SEQ ID NO: 33895 - DNA, 401 bp, Homo sapiens
ggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagcttggaagatggacgcaccctgtctgactacaacatccagaaagagtccaccctgcacctggtgctccgtcttaga

SEQ ID NO: 33896 - DNA, 392 bp, Homo sapiens
  misc_feature 83, 222, 275, 309, 339, 340, 390: n = A,T,C or G
agatgaaatgatgagatgatgaaataaaatgatgaaatgatgagatgtgatgagatgaaatgatgagatgagatgagatgacntgaaataatgaaatgaaattgaaatgagataagataccgagatgagatgaaatgatgagatgaaatgatgaaatgatgagataagatgaaaagggttgagatgatgagatgaaatgagatgaaaagatgaaatgatganatgaaatgaaatgatgagatgaaatgaggtgaaatgaaattagatgaaatgtnatgagatgaaatgacatgacgtcatgaaatgaantaatgaaatgagatgaaataaaataatganntgatgaaataatgaaatgaaaatgaaatggaaatgatgagatgagaaganat

SEQ ID NO: 33897 - DNA, 434 bp, Homo sapiens
  misc_feature 339, 426: n = A,T,C or G
ggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcanatcttcgtgaagaccctgaccggcaagaccatcaccctggaagtggagcccagtgacaccatcgaaaatgtgaaggccaagatccangataaaga

SEQ ID NO: 33898 - DNA, 259 bp, Homo sapiens
  misc_feature 3, 21, 257: n = A,T,C or G
gancgttaagtattttgatcnctgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatncg

SEQ ID NO: 33899 - DNA, 275 bp, Homo sapiens
cgcggtggctcacgcctgtaatcccagcagtctgggagaccgacgtgggcggatcacctgaggtcgggagtttgaggtcagcctggctaacatggtgaaaccccgtctctactaaatatacaaaattagctgggcatggtggcacatgcctgtattcccagctactcggtaggctgaggcagaagaatcgcttgaacccaggaggcggaagttgaggtgagccgggatcacacaccactgcactccagcctgggcaacggagtgagactccatct

SEQ ID NO: 33900 - DNA, 464 bp, Homo sapiens
  misc_feature 21, 40: n = A,T,C or G
accccggggaaattccggccnttatggcccgggataagcnggttgctcagctgcatcccctgtctggttacctcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatttgggagatacatgacgcgaagacggatttcacatccacaggacggtcttgaagaaaataac

SEQ ID NO: 33901 - DNA, 451 bp, Homo sapiens
  misc_feature 2, 6, 37, 38, 54, 315: n = A,T,C or G
ancgcntgccagaaatgggcctccccgccaaagtaannggtgggcgagaagaanaaagggcccgttcctgcccatcaaccgaagtggtaaccccgagaatacacccatcaacattcacaagccgccatccatggagtgggcttcaagaagcgtgcaccctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggnatgaagattcaccaaataagctatatactttggttacctatgtacctgttaccactttcaaaaatctacagacagtcaatgtggatgagaactaatcgctgatcgtcagatcaaataaagttataaaattgcctac

SEQ ID NO: 33902 - DNA, 417 bp, Homo sapiens
  misc_feature 255: n = A,T,C or G
ggaagccggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttnggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccat

SEQ ID NO: 33903 - DNA, 424 bp, Homo sapiens
  misc_feature 9, 10: n = A,T,C or G
ctccggccnntttatggcccggggtgagcagccctgtttatttctctaatattatgtcagtttattctctttaatggactgtaaaaaaatgtaatcacaagagtgccaaatatcttgaaatgccagaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcc

SEQ ID NO: 33904 - DNA, 375 bp, Homo sapiens
  misc_feature 7: n = A,T,C or G
ctagccntggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccgcctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacaca

SEQ ID NO: 33905 - DNA, 379 bp, Homo sapiens
  misc_feature 8, 18, 50: n = A,T,C or G
cggggaantttccggccntttattggcccgggaaggtcagcttctagttnaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagc

SEQ ID NO: 33906 - DNA, 418 bp, Homo sapiens
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtggggctgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaga

SEQ ID NO: 33907 - DNA, 125 bp, Homo sapiens
  misc_feature 7, 8, 28, 34, 38: n = A,T,C or G
ccggccnntttattggccgggggaggcnaagatncccnggcccccccaggtgttctcagggcagttcttggtgtctgcttctcagattccaaggactggaattaaaacctttcctgggactctgg

SEQ ID NO: 33908 - DNA, 324 bp, Homo sapiens
  misc_feature 3, 6, 26, 28, 32, 38, 42, 46, 80: n = A,T,C or G
aanctnggccaacaatggcccgggancntgangcttcnttangctnagtgaagttttattctgtgtgctatattttagancgtctgtcttcacaacaaaatttctcctcttcccaaacccccacatttccctctgatgggtcccagattagtattctgtactctttctcccttagtgtatgcctatatttatttagcaccaacaacatactgagtcacagtgttggatactgtgataaatgtggttcattaatatttttcctaatgacttcagtttttcatgaaaatgatgcctactcagtataaaaaattaaggcaatagagc

SEQ ID NO: 33909 - DNA, 450 bp, Homo sapiens
  misc_feature 9, 15, 27, 32, 33, 36, 39, 42, 48, 54, 58, 64, 65, 71, 73,94, 105, 118: n = A,T,C or G
cggggaggnaggtgnggaagggtaganccccnntangcntcnttggcntggtanttanttcccnnctttcncnaccccgcttataaaagaggcntgtaaaaaganctggataatttantaaaagaaagaggtttaacctgacaccaccagttcagcatggcttgggaagtcctcaggaaacttacgattatggtggacagcaaaggggaagtaaggcgccttctttataaggcagcaggaaggagaatgaacacaggaggaactaccaaactcttatacaactgtcagatcctgtgaaacctcactatcacaagacagcatgtgggaaaccaccgccataattgagttacctccacgtggtctctcctttaacatgtggggattatggggattacaattcaaaatgagattttgggtgaggacacagccaaaccatatcacttgccatac

SEQ ID NO: 33910 - DNA, 208 bp, Homo sapiens
caaggtttctaccaaatcggcatttggagcagagttgtttgtttttgttgtttgtttcctttaagaaaaaccacaggggccaagaaagaaaatataacagtttgatttctgtcatacccattgtatttgaagatatatggatacagattatatatatatacatattttccttaatagaggaatgcttcatattattcaaaaattatat

SEQ ID NO: 33911 - DNA, 339 bp, Homo sapiens
  misc_feature 2, 10, 23, 27, 42, 47, 50, 55: n = A,T,C or G
cnagggggantcctggtttgttngggnccggggccggtttanttaanacnaagcntccgcgaaggccccgcggcgggtgttgaccgccgatgtgatttctgccaagtgctacagaatgtgaaagaaggaagaaccccttgcgaattggagtcaataaagaagactccatggatgagcgaggaggagcagtattagataaatggagagaaaagaaggaaagacatagtgtgactgggtgaggtttggcacagagttcttgggaatggtctttgttgtgctagagtttatcatccattgctgaggggtgagtgtgtcgtcccctctaggacctttagccag

SEQ ID NO: 33912 - DNA, 351 bp, Homo sapiens
  misc_feature 2, 6, 31, 71: n = A,T,C or G
anctantgggcccgggggagtaaggcaggangcctgagccgatcccgtactcagaacgtccaggaagagancgcatggccccgaagtcaaagtgctggaattttccaaaacagcctgttctctcctctctcctccccagagcaccccctgccatcagggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgagga

SEQ ID NO: 33913 - DNA, 415 bp, Homo sapiens
  misc_feature 2, 5, 116: n = A,T,C or G
cnacncggggaaattcggcaatttattggcccgggtgaagcttaagtgaggatttccttgcaatgagtagaatttcccttctctcccttgtcacaggtttaaaaacctcacagctngtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggaga

SEQ ID NO: 33914 - DNA, 274 bp, Homo sapiens
  misc_feature 22: n = A,T,C or G
cgggggggcgagttgttacccnagcattaggtagcctaatacatagtccttgcaagagttcgttttttggctgagcattatgttcttgaggttcatctgtgttgatacctgtagttgtagttcatctgttttcattactatgtgcctttcccctgtaagtagtcccccccttatctgcaggggatacagggcccccagaaggtgcctgaaacttcagatagtaccaaaccctgtatgtactatttattttttcctatgtatacatgcctatgag

SEQ ID NO: 33915 - DNA, 256 bp, Homo sapiens
  misc_feature 2, 10, 175, 233, 238, 251: n = A,T,C or G
cnaaataccnctttatgcagtggatctgttgtgatatcccgctaccctggacgtcagtatcttgggcaagtttgcagttgtgatggctgacccaccctgggatattcacatggaactgccctatgggaccctgacagatgatgagatgcgcaggctcaacatacccgtactacanggatgatggctttctcttcctctgggtcacaggcaggtaatgcaattcagttatgtanggatngacagatccagtncaaga

SEQ ID NO: 33916 - DNA, 136 bp, Homo sapiens
  misc_feature 7, 12: n = A,T,C or G
agatccnaaacnaaccaggccaaagtatcttggttccctcctttaagacaagatgtgaaagtacagaatccaacttagactgtaatttatcaatgttgagatgagtataattctggattagatggggagacatagc

SEQ ID NO: 33917 - DNA, 173 bp, Homo sapiens
  misc_feature 22: n = A,T,C or G
aagatataggcctctgcccagnatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggc

SEQ ID NO: 33918 - DNA, 295 bp, Homo sapiens
  misc_feature 4, 5, 243, 257, 260: n = A,T,C or G
tggnngggcatgttgcccaggctggtcttgaactcctgagctcacagttgccaaattcagtaacttctttttgttttgtgtctgctttgacttctctgcagcagcttctgtgaagctctaatctcccgagttctctggctcttagacactggtgtgtgccatctctgacttctctattcgctgttttttaacacatacacacacacacacacacacacacacacacacacacacacacacganctaagatggaaaantgncacacacacacacacacacacacacacacacacac

SEQ ID NO: 33919 - DNA, 380 bp, Homo sapiens
  misc_feature 21, 27: n = A,T,C or G
cggccctttatggcccgggcnaccttnaccctgcccccattacaaaggaaggaaatgaagaagccagtgaaaaataaagtgtgtggccacacctatgaagaggacgccattgttcgcatgattgagtccaggcaaaagcggaagaaaaaaggcctattgccctcaaattggctgtagccacacggatataagaaagtcagatcttatccaggatgaagcacttagaagggcaattgagaaccataacaagaaaagacatcgtcattccgagtaggaaaagccccctgcctgcagggacaccagcagcctacctcctaccccagctgtctgttgagagcagtgctgaccccagcagttagggactggctgcatagcatact

SEQ ID NO: 33920 - DNA, 118 bp, Homo sapiens
gaacgcagctagctgcgagaattaatgtgaattgcaggacacattgatcatcgacacttcgaacgcacttgcggccccgggttcctcccggggctacgcctgtctgagcgtcgcttgc

SEQ ID NO: 33921 - DNA, 362 bp, Homo sapiens
  misc_feature 5, 10: n = A,T,C or G
aagcnttccnaagagagctggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctataagccctaccttcatgccccggtccactcagcctttaacctttaccactgccacttttgctgccaccaagttcggctcta

SEQ ID NO: 33922 - DNA, 166 bp, Homo sapiens
gtatacaaaatagcctttacctagattttaatttgcccataatttaaataataaaaattgttgtttatgttttaccctccctggctctggtgacttcagactttcatcatgtgattggaaagaaaatttcagggagaacacagtggattgtccccacaatcttggc

SEQ ID NO: 33923 - DNA, 202 bp, Homo sapiens
caaacacaccaccgcaaggcagcacccctcccccttagagatccaggtgactccactgagaattactgcgccacaccgtggcttctagacccacactgtcaagtatgtagtccttgccacctgggctgttgaacctggaaatgaggcttgtacgaactgactaaaagtgcaaaatacacattggattttgaagccttattac

SEQ ID NO: 33924 - DNA, 375 bp, Homo sapiens
  misc_feature 1, 7: n = A,T,C or G
ncggccntttattggcccggggaagaggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggtactttccat

SEQ ID NO: 33925 - DNA, 345 bp, Homo sapiens
tggagagtggggtttctttcatttaccttctgtggaatgagccttgtattgttttaaaaagtggtatttgtgaatggcaaaagagcagtgtgtgggagtcatatttgttgcagcctggctgctatgtgccctgtgctctctagaaggtaaaaaaatatcctggtccgtatctcatgcccctagcccctcccaaagttgctgcagctgagcccagcagcctgctctctcctttccctgggtctcccagtggatgccatttctgaatgaatgcatcagaggaatccttccaggcactcaaataatggaaggtgcaacctcacagtacatgactgcagtcacaggaac

SEQ ID NO: 33926 - DNA, 304 bp, Homo sapiens
  misc_feature 3, 12, 35, 42: n = A,T,C or G
aanttccggccntttatggcccgggccgcaaaccnagggccnaaaatttaaagacccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagcc

SEQ ID NO: 33927 - DNA, 409 bp, Homo sapiens
  misc_feature 2, 7, 35: n = A,T,C or G
cntggcnttaaactgttgaggcttttggccctgcncttatctcatggtgctttcagaaaaatcagttgactgcttgaagccttcagtttccttttctgtaagttgagagtgaagagcactataatactatcatctacctcattgcctttgaaaattgattatgagggtcaagtgcagtaatacagacatacctcggaaataccttgggtttggttccaggtggccacaataaagtgaataatgcaattaagcgagtcacatgaatttttttgtttcctagtgcattaaagttgtgtttatactataccataccatatcatactacactatattaagtgtgtaagaacactgtgtctttaaaagcagtatacatactttaattaagggatacctttattaccattcaaga

SEQ ID NO: 33928 - DNA, 413 bp, Homo sapiens
ggggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagaga

SEQ ID NO: 33929 - DNA, 331 bp, Homo sapiens
  misc_feature 19, 37: n = A,T,C or G
ccggggaaatttccggccncttatggcccgggatccnttgaataaatagagctcaatattttaaatcttcaggaatagatggtgaattctaccaaacatttaatgaaaacaataatcctaatcataatcataaactgatatggtttggctgtgtccccacccaaatctcaccttgaattgtaataatcctcaagtgtcaagggtggggccagtggacataatcgaatcatgggggcagtgtccccataagtgaataagtctcacgagatttaatggtttttataaatgggagctcccctgcacaagccctcttgcctgccgccatgtaaga

SEQ ID NO: 33930 - DNA, 390 bp, Homo sapiens
ggcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactggga

SEQ ID NO: 33931 - DNA, 385 bp, Homo sapiens
  misc_feature 3, 24: n = A,T,C or G
ctntgggccccgggtacctttttntacttaaaaaagacccctggatttaaccttatgaaaatccaaatgccaggatagtaatttttgtttacttttttaaccaaactgaatttttgaaagactattgcaggtgtttaaaaagaaagaaaagttgttttatctaatactgtaaggtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtac

SEQ ID NO: 33932 - DNA, 319 bp, Homo sapiens
  misc_feature 5: n = A,T,C or G
cagcnaggtgcagtagctcatgcctgtaatcccagtactttgggaggcctaggcaggcagatcactgcaggtcaagagtttgagaccagcctggccaacatgatgaaaccctgtctctactaaaactacaaaaattagccaggcatggtggtgcgcacctgtaatcccagctactccggaggctgagacaagagaatcacttgaacctaggaagtggaggttgcagtggcagtgagccaagatagcgccactgcactccagcctgggcaacagagcaagactccatatatggagatcccttgagatcaagagttcgaga

SEQ ID NO: 33933 - DNA, 396 bp, Homo sapiens
  misc_feature 4, 10, 35, 40, 47, 60: n = A,T,C or G
cccngggaanttccggccctttattggcccgggcnttccnaaaaccntacctttaaagcnttatgtgccaattaagttgttatgacataattatattgcctaattgttgggtcttttttcttgagcttataatgtacctggaaaataaacctcttgagaaaaagaaaagttcatactgattattggaaaaggactatatatgtgagcaagatcgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacac

SEQ ID NO: 33934 - DNA, 155 bp, Homo sapiens
tgaaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttc

SEQ ID NO: 33935 - DNA, 311 bp, Homo sapiens
aagtgccaggaggagctaaaatttataggtggctccccatgtgcgaatattacacaaggcacctgccaggcaccctctcattctgtcttccccataactcctgggaggaaaggcacaaacacgaccccaattcacagatgaggaaagtcagctttgagggccaacgtgttcagtgcacagagctgacagtggcagacgcgagttaggaatccagctgcggccgactttacgctgcacgctcagtgttaattcagcttttatctttgctttaatagaaatgaaaaatccattttgttctcataaaatgatga

SEQ ID NO: 33936 - DNA, 378 bp, Homo sapiens
  misc_feature 10, 11, 27: n = A,T,C or G
cttccggccnntttatgggcccggganattcaaaaaagcctacccccgcacttgtatgtttattgcagcatcattcgtaacagcaaagatatggaatcaatctaagtgtccatcaatggatgactggataaagaaaatgtggtatatatacacaatggaatattattcaatatatatacacaatggaatattattcatccatggaaaaggatgaaatcatgtcttttgatggatagacatgatagaacatggatagaactggaggccattttcttaagtgaaacaactcagaaacaaatagtgtatgttttcattgagaagtaggagctaaataatgtgaacacatggacatagagtggaataatggacattggagac

SEQ ID NO: 33937 - DNA, 223 bp, Homo sapiens
  misc_feature 2, 12, 34, 40: n = A,T,C or G
cnccccgggacntccggcccttatggcccgggancagtcnttcagcttaccttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgac

SEQ ID NO: 33938 - DNA, 347 bp, Homo sapiens
ggtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtga

SEQ ID NO: 33939 - DNA, 255 bp, Homo sapiens
  misc_feature 12, 13, 42, 50: n = A,T,C or G
ctccggccaatnnatgggcccgggggaacttgaaccgaggcnttttaatntgctgtagtttatttccaccccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgc

SEQ ID NO: 33940 - DNA, 384 bp, Homo sapiens
  misc_feature 1, 4, 30: n = A,T,C or G
naanttcggccatttatggcccgggggcgnaatagatatagtaccgcagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacact

SEQ ID NO: 33941 - DNA, 247 bp, Homo sapiens
  misc_feature 7, 43, 55, 95, 99, 108, 120, 160: n = A,T,C or G
aattcantgctcttgctggtatgagacccgaatccctaacagnccagccctatancccaggcagcacagctttatcaggaaaacaaacgagaatntganaaaagagtntcggccattgtngaacaaagctggaatgattcataatagacaactggtctgntaatctttttcatcattgatgtgtataattcacctctcattagaaaggctaacaaattttaagtgccacaggttttaaggattctgc

SEQ ID NO: 33942 - DNA, 170 bp, Homo sapiens
  misc_feature 107, 145: n = A,T,C or G
accacgtgaccaacttgcgcaagatgggagcgcccgaatctggcttggcggaatatctctttgacaagcacaccctgggagacagtgataatgaaagctaagcctcnggctaatttccccatagccgtggggtgacttccctggncaccaaggcagtgcatgcatgttgg

SEQ ID NO: 33943 - DNA, 169 bp, Homo sapiens
cagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgc

SEQ ID NO: 33944 - DNA, 369 bp, Homo sapiens
  misc_feature 13, 14: n = A,T,C or G
aaatttccggccnntttatgggccgggggatggagcccagttggaaaattcccaaatattacaacaagtccttgaaccccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagc

SEQ ID NO: 33945 - DNA, 375 bp, Homo sapiens
  misc_feature 6, 13, 29, 45: n = A,T,C or G
accccngggaaanttccggccaatttatnggcccggggggatgtncgtggcgctttaggggaagaagttggtgtttcgctgggcccctggtactgaagacgcggtccgggtcgcccctagctgtttcctactcacccaaagccccgcacccgccttttctctctctcctctggcaggatgaggcgtgcaggcctgggtgaaaggagtacctcctggcaactatgggaactatggctatgctaatagtgggtatagtgcctgtgaagaagaaaatgagaggctcactgaaagtctgagaagcaaagtgactgctataaaatctctttccattgaaataggccatgaagttaaaacccagaataaattattagctga

SEQ ID NO: 33946 - DNA, 370 bp, Homo sapiens
ggttgggggccgtcccgctcctaaggcagggagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgagatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactg

SEQ ID NO: 33947 - DNA, 303 bp, Homo sapiens
ggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagttcagaagggtcaaaaagctccagcccagaaagcacctgctccaaaggcatctgccaagaaagcataagtgg

SEQ ID NO: 33948 - DNA, 461 bp, Homo sapiens
ggctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgagatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcggccttatctggccacctggagacggtgattttgggcctattgaagacacctgctcagtatgacgcttctgagctaaaagcttccatgaaggggctgggaaccgacgaggactctctcattgagatcatctgctccaga

SEQ ID NO: 33949 - DNA, 144 bp, Homo sapiens
  misc_feature 12, 13, 74: n = A,T,C or G
tgggcccggganncgtgatgccttcaaaaattttgtaaaattgtttattttaaaaccttatctgtttgtaaatngtaactgattaagaattgtgatagttcagcttgaatgtctcttagagggtgggcttttgttgatgaggga

SEQ ID NO: 33950 - DNA, 217 bp, Homo sapiens
  misc_feature 33: n = A,T,C or G
acctaaggtcgggagttcgagaccagcctgacnaacatggaggaaccccatctgtagtaaaaatgcaaaattagctggttgtggtggcacatgcctataatcccagctacttgggaggctgaggcagaattgcttaaaccctggaggtggaggttgaggtgagccaagattgcgctattgcactccagcccgggcaagaagagtgaaactccgcctc

SEQ ID NO: 33951 - DNA, 260 bp, Homo sapiens
  misc_feature 31, 39: n = A,T,C or G
ataacctgaactcctcacacccaattggacnaatctatnaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttat

SEQ ID NO: 33952 - DNA, 369 bp, Homo sapiens
  misc_feature 18: n = A,T,C or G
gaggcattgaggcagccngcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 33953 - DNA, 418 bp, Homo sapiens
  misc_feature 7, 39: n = A,T,C or G
tcggccntttatggcccgggatgcctaacctgagaagangccccgataccctggctgttaaagaagtgctttgtcatctaattgaatgcaataaagatgttccagggatctctcagatcaattgggttattcatgtggttgattccccaattattaatgccttcgtgcttccatatatgtttaatagaccatacagcagaaaattggaggccgaagctgacaaaattggactactgcttgctgcaaaggcttgtgcagacataagagccagttcagtgttttggcagcaaatggagtttcgttgatagcctgcatggccaacccaagatgccagaatggttatctacacacccttctcatggcaatcgagttgagtacttggatagacttatacctcaggctctcaaaattagagaga

SEQ ID NO: 33954 - DNA, 160 bp, Homo sapiens
  misc_feature 15: n = A,T,C or G
gataacattcttgtntcgtatttaaacctgtaggaaaacatgcttgggatgtaatttttacagaactatagaactctccttctgttcttgataaacccatctacgaatcttttttatattagttttgcttctcctgatcatttatttacatgtctttgac

SEQ ID NO: 33955 - DNA, 400 bp, Homo sapiens
ggcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttga

SEQ ID NO: 33956 - DNA, 141 bp, Homo sapiens
gataaatgcttgaggtgatggaaaccccaattccctgattcgatcattatacattgtacgcttgtatcaaatttcacatgtacttcataaatacaactattatgtatccataaaaactaaaaattaaaagataaatctgag

SEQ ID NO: 33957 - DNA, 383 bp, Homo sapiens
  misc_feature 9, 10: n = A,T,C or G
ctccggccnntttattgggcccggggagggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtacttaaaagaaaattgagagaaaggactacagagccccgaattaataccaatagaagggcaatgcttttagattaaaatgaaaggtgacttaaacagcttaaagtttagttta

SEQ ID NO: 33958 - DNA, 500 bp, Homo sapiens
  misc_feature 3, 16, 40, 52, 54, 61, 66, 76, 89, 92, 103, 120, 132, 149,208, 233, 394, 414, 420: n = A,T,C or G
tanatggggtaccacnttctccgggtaaaaaggtgggaantgggccagggantntactaantgganttaggtggcncctttgggggatntanagcctgccttncaggggccagtggggantcctttcttgantgtccgtgccgggagancaccgcccctttcccttttcttccagccacccgtccccttcagtattacccccggtacnactttgccctttgagcccttttacncactttttgtggttcttgtccctctcttcacagtcaccccaaacagtgatagcccaagggcataagcagcccgcaagaaagctggagctccctatgtaaaagcctagcattcagtaaaattccataacaaggaagttgtgccaacatacaatcgtgacttnttaggagtacagaatatccnggggtnggaccagatactagatcagcagtcagcagtccaagtcaggagaaaaatgtgcaaaaaacaggggctgacttttgcaattc

SEQ ID NO: 33959 - DNA, 318 bp, Homo sapiens
gagactctttggagcatactcctaaagtgcacagaagaaaatacagcttaagaatgctgctgctggccgggcacagtggctcacgcgtataatctcagcactttgggaggccgaggcaggtggatcacaaggtcaggagttcaagatcagcctggccgggatggtgaaaccccatctctactaaaaatgcagaaaattagccaggcatggtggtggctgcctgtggtcccagctactcgggaggctgagtcagagaactgcttgaacccgggaggccggaggttgcagtgagctgaggtcacaccactgtactccaga

SEQ ID NO: 33960 - DNA, 183 bp, Homo sapiens
atccacataatctaaaatatgggaatgagaccagattgaaataatctgggtcaggggatgaaaaccttagattaagatgaagacagagtgatttaaaaacctgaatttttaatgcagattacacttaaaaattgataaaatagaaaagggatatactaggagtgagctctcctgcatattgag

SEQ ID NO: 33961 - DNA, 415 bp, Homo sapiens
  misc_feature 12, 30, 31, 44: n = A,T,C or G
tgggccgggaanctgccttcatcttctctnnttttgtttcctcntttgtaaaatagggatgacagcaaccagtatttacttctcagggttgctgtgaaggttaaatgagttactgtgagtaaaacacttaaaatggtgcctggcccatagaaacatgacataatttcataggaataattttactttattcaaaatagttttctattctacatttttagatgaattcatgcacagagtggagaaggaatatgaacactgtctgtgagattctggccttaaattcattccatcacaatcctatttgagagcccttagaagaaagttttgacatttgagctttattttcacatttcaaattcaatccacaaaaattcccccatgtgatccttacttggacttgaaagcagattttttt

SEQ ID NO: 33962 - DNA, 370 bp, Homo sapiens
  misc_feature 4, 14, 29, 32, 84: n = A,T,C or G
agangccctggccnttccccccagcctantantggcccagcccccctagccttttgagttaaccctaccctgaggtccccagancatttgtggagcagagatgtagtccatcccttgcccgtgctctcacacatgaatctgagatgtcataatcaatttttatcttaagccactaagttagggtgtagtttgttacacaacaatagatgactggaacctgaaaatgatagttaatttaccctatttttggaaaattaggttattttcagttttacactgttgctaataattatggttaaacatatttgcatataaatctagatgaatatctggttatttcttcagtataaatttctagaaatataattac

SEQ ID NO: 33963 - DNA, 197 bp, Homo sapiens
  misc_feature 2, 4, 12, 13, 17, 24, 29, 32, 40, 49, 54, 64, 88, 95: n = A,T,C or G
cntntccgcaanngacngagtaanagacnaanaagagtanaaaatgaanggaantaaaaaaganggccagggccattgtggcctcacnaccctantaatccccagccacctttgggaggcctgagttggaagaattgctggagcctaggactttgagacccagccctggcaacacagtgagacccccgtctctactg

SEQ ID NO: 33964 - DNA, 267 bp, Homo sapiens
  misc_feature 5, 20, 27, 38, 55, 61, 66, 257: n = A,T,C or G
aggcntgccttaggggcccnagggaangtgggaaaganggggaaagtgacctacncaaganggaanaaaggaaccttttgagggttgatgaccaatgtttagaatccctgaccttcagtggttgttaccctgatacacttaaaagtggcgaattttagtgtataaaaattttatcccccagctactcaggaggctgaggcaggaggattaccttgagcccagaagttagaagaccaggctggacagtatagtgaganccctgtccca

SEQ ID NO: 33965 - DNA, 155 bp, Homo sapiens
  misc_feature 4, 9, 13, 28, 31, 49, 51, 60, 70, 77, 78, 88, 89: n = A,T,C or G
cgancttantaanctgggtggccggganccnaggggggaaatccccgancnggttttaanttaaaaaacnaaaaacnntccgccgaannggcccccgcgggcggggtggtttggaccgccgatgtgatttcctgccccagtgcctctgaatgccc

SEQ ID NO: 33966 - DNA, 116 bp, Homo sapiens
aggctaaggtgggtggatcacctgagcctgggaggtcaagactacaatgagccatggtcacaccactgcagtccagcctgggcaacagagtgagaccctctctgaagaaaaaaaag

SEQ ID NO: 33967 - DNA, 213 bp, Homo sapiens
  misc_feature 2, 18, 31: n = A,T,C or G
antgccaagtacctagtngtttttagaagantaacccttgatgaaaacaatgtgccttttgaaagtagtcgcaggatagagaaatcgtgtatatttaatgtgatcagctcaggaacatatgcctggcctgtcagcattgactgaccaattttatttcaggggaaaaccagaaaacatacttattcctactgacagttgacctttttattatta

SEQ ID NO: 33968 - DNA, 430 bp, Homo sapiens
  misc_feature 4, 11: n = A,T,C or G
aaantcggccntttatggcccgggatttccctttctaaagtctaggctaatgtttttcagatcgctaagttgtagtttgtctggaatttaggaagccatttcagtatttgtcacttggtgaacgaacattcaataccttcagatgtcttcgtgttgacttgtattcatcctaagaaatagtaaatatagtctcaagtgttatttatgttatactgctggtttattctctgcttaaattattgacataaatttctactttggaggcttttcgtttgaactaaggctgtgcggaatttattttacttttatatttaaatctttgaaaaatctctgattaaaaaaaaagtacccttaagggtttgaggatgtcctttcacaccagacaaaatttggttaatttgcgcccaatattcattactttgacctaacc

SEQ ID NO: 33969 - DNA, 471 bp, Homo sapiens
  misc_feature 8, 9, 23, 29, 34, 35, 46, 50, 63, 69, 73, 76, 89, 117, 127: n = A,T,C or G
cgggggcnnggggccgccggtgngtcgcngtgcnntgtagccctcngccntcctttagtagcntgggancacnganattctgtcacccncaccccagcctaacttttttgtattttntggtagagancggggtttccgccatattgacctgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataatttggattacacaggcaggcttgtttactacatccagaatgtagaaactgctttcttcaacatcttggttctagctactaataacaatataattctttggcagatattcagaataacattttaaactacattttcttagaaaattgcattcttgtagtgagc

SEQ ID NO: 33970 - DNA, 390 bp, Homo sapiens
  misc_feature 6, 11, 35, 36, 45, 56, 370: n = A,T,C or G
tccccntggcntgcacctttgggcttggggtttgnnagtccaganaccaccagatncctcaccctgggagaaaccctctttttctccctcgactctttcctacgtaaaactcccacccctgacttacccctggaggaggggtgacccacccaccctgatgggattgcaccggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaagtgtaaaatatgtatatatccaaagatatagtgtgtacatttttttgtaaaaagtttanaggcttacccctgtaagaac

SEQ ID NO: 33971 - DNA, 236 bp, Homo sapiens
  misc_feature 10, 50, 236: n = A,T,C or G
cctgggaaanctccggccaatttattggccggggtttgttgctgataaancggatttttctgtatggttctgtggcaagagatttcataatttctactgcacttacattcaacacttgatgattcactattatagtaaggatatatgaatttcaaaaaatgcctcataacctcaatttttaagtcatgttagctgagagactttcaaagttttgataaataaaaattgacaagtcn

SEQ ID NO: 33972 - DNA, 149 bp, Homo sapiens
  misc_feature 1, 2, 20, 23, 24, 45: n = A,T,C or G
nncagtgccggccccgagcnganngcctattgtgcctagagggcnaaagagttggagttctatcttaggaaaatcaaggcccgcaaaggccaaataaatccttgttttgtcttcacccatgtaataaaggtgtttattgttttgttccc

SEQ ID NO: 33973 - DNA, 387 bp, Homo sapiens
  misc_feature 3, 18: n = A,T,C or G
tantgggcccggggaacnaaccgaagttaaaataatcttaccttgggtagagatggcctttgcccaaccaaagtgaactgttttggttgttttaaacctcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgagga

SEQ ID NO: 33974 - DNA, 386 bp, Homo sapiens
  misc_feature 10, 13, 40, 50, 67, 79: n = A,T,C or G
accaggccanctngggcccggggcaagccaaaacaagtangggtgaaaangtgaacccctcgcccanggtaaaatacantggctttgcttgccctgttgtacccgtggtggaccgtggttccccaaagatgtcaatgctgccattgcccacccatcaaaacccaagccgcagcatccagtttgtgggattggtgccccactggcttcaaggttggcatcaactaccagcctcccactgcggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtga

SEQ ID NO: 33975 - DNA, 245 bp, Homo sapiens
  misc_feature 6, 11, 24, 40, 41, 62, 73: n = A,T,C or G
aagaanttgantagtgaagggtantaaaaagtgtaacccnntcagttaaaacccctctcccngtcatttcccngggcctttcccttgccttcagaaattgaaatggaagtggggggtgtcccctacctcctgtagaaatcctgggactgggcaaatgtttgtgtggccctccttaaactagctgttatgttatgattttattctttgtgagttaattagaataaagtcattttcttccaaggtca

SEQ ID NO: 33976 - DNA, 409 bp, Homo sapiens
  misc_feature 3, 23, 34, 35, 36, 39, 41, 45, 51, 52, 77, 93, 111, 115,220, 267: n = A,T,C or G
tcntgggtccgccgggccaaagngccgggaaaannngcntngggngggaanngggtgggtggcttaaagccgcccantccgtaaagggtggcntccccggggataaaccantccnaggggccatttacaaaaacccggctatttccgcccgttttgggcctccggccgccggtgggcgtcaaagccgccattttcccggtctttatctattgaaggaagnctcgagggtgtgcttaaagggttttcttagagaacgttattcgagancgccgtcaccctatacggagcacgcccaagcgcaaaactgtcacagccatggatgtagttatatgcccctgaaacgtcaggggcgcactctgtatggcttcggcggctgaatctaagaatacgcggtctcctgagaacttca

SEQ ID NO: 33977 - DNA, 170 bp, Homo sapiens
  misc_feature 13, 18, 26, 27, 32, 34: n = A,T,C or G
cgggaccttaaanacganggggaaannggganantgtgccttcctagaacctgtgatattgaattacctttccttctaagggccagatctcaatagaataaaataaaaattaaccctggaaagaatttgttttatatcagtatggtttgtaacaaagaacattattaacc

SEQ ID NO: 33978 - DNA, 172 bp, Homo sapiens
catgatgagggatgggatgaaggcagcaaggggtaaccatcttgaccttctgttttttctctcccctgcaggaagccacaagcagcccagccctccttaatcaacttcaaggagcaccttcattagtacagcttgcatatttaacattttgtatttcaataaaagtgaagac

SEQ ID NO: 33979 - DNA, 233 bp, Homo sapiens
  misc_feature 16, 22, 46: n = A,T,C or G
tgcaaccacttgaatnaaatanaaattgaattaaatttttaaattnaacagaaaatagcaaattggttactagaatattttgtctctaccaatttcactattacttctgaggtgtaaacccaaatataatactggcataaagaaggaaaaatatctcaagatttctaggcattttcctatgtctaatagtaggatgttctctctgaatttatttattacaaaaataacattac

SEQ ID NO: 33980 - DNA, 420 bp, Homo sapiens
  misc_feature 5, 11, 18: n = A,T,C or G
gggancctccnttttgcngtgctgtaagaagtaccttaaaaggtgatgccctcccaaaatcattgatgatttacagaagttttggtttgaatttactggttgagtttcctttgtttctttttttctcccacgagatactggttttactttagttaaatgtaattttctgtgttctaggcactgatttcagtactgcttttaagattttaattcatttaatccctacaacaacccagtggaattagttactgttactatatctgtagtgcagatgagggaactgaagcacagggacaataagcaacttgcttaggttcacacatcttgtctgtggtggagctaggacttgaactcaggcagcctggctctagaatacgtgctcctaacatgctgcttttcttgctttatcagggcaatgag

SEQ ID NO: 33981 - DNA, 252 bp, Homo sapiens
  misc_feature 2, 3, 15, 105, 214, 246: n = A,T,C or G
annccctgaagggantttcctttctgatggtagccttttgtattatcaagtaagaattctatttttcagttgtgtgtaagccaagttttttttttagtgtagganaaatacttttccattgtttaactgcaaaacaagatgttaaggtatgcttcaaaaattttgtaaattgtttattttaaacttatctgtttgtaaattgtaactgattaanaattgtgatagttcagcttgaatgtctcttanagggtg

SEQ ID NO: 33982 - DNA, 336 bp, Homo sapiens
  misc_feature 2, 14, 30, 34, 64, 71: n = A,T,C or G
tnggcccggggaantcctaaatgccctgangaanctgtcatttgtctatcatcaccccccagangggaccnctgccagttgcaggaaaacaagttcagggctcccactgattctacattatggtgagttgtataatgatttcattctattgtatgatataatagtaataatagaaataaagtacacagtgtctgtaatgcgcttaactcatcctgaaaccatcttccctattctgtctgtggaaaaattgtcttccacgaaaccagttcctgatgcccgaaaggttggggaccattgctatagaagaaagaagggcctgaaaataatttgagatat

SEQ ID NO: 33983 - DNA, 344 bp, Homo sapiens
cactggggaatggagcaaaacagtctttgaatatcgaacacgcaaggctgtgagactacctattgtagatattgcaccctgtgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttg

SEQ ID NO: 33984 - DNA, 382 bp, Homo sapiens
  misc_feature 12, 13: n = A,T,C or G
atggcccggganntccttttattttctaaggagttaaacatagatgtagcctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggccagaagtgcttttttttgatcaactg

SEQ ID NO: 33985 - DNA, 295 bp, Homo sapiens
  misc_feature 15, 18, 39: n = A,T,C or G
tccttgtgaggaaanctntcaccctaaacctggaagtcnttcccttaacccgagccatattgtaagttgacccctggaggttcaaagagaaaccttaccgtagccctaatagtgtggcttgcccattctatgcccctgtactaaaaaataatgtaacctttcatgatttcgattgggtggaataatttttagttacgataattgcactgaaattaggtctttaaaaggttcttggtttttagttatgatactaaaatatttaccagtgaatttatatgatgtgtaaggaggtact

SEQ ID NO: 33986 - DNA, 451 bp, Homo sapiens
  misc_feature 3, 29, 31: n = A,T,C or G
ganctcggtggtggccacctgcgccagancngacttcgctcgtactcgtgccgcctcgcttcgcttttcctccgcaacccatgtctgacaaacccgatagggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaacttttgtaagatgcaaagaggttggatcaagtttaaatgactgtgctgcccctttcacatcaaagaactactgacaacgaaggccgcgcctgcctttcccatctgtctatctatctggctggcagggaaggaaaagaacttgcatgttggtgaaggaaga

SEQ ID NO: 33987 - DNA, 177 bp, Homo sapiens
  misc_feature 2, 14, 16, 18, 29, 34, 37, 38, 42: n = A,T,C or G
ancaacttccggcntngnggccgtccgantgaanganncgcnagccttagccttgcgaagaaattaaatggtgaaattggcagggacaccatttgatcatccgacacctttcgaaacgcacctttgcggccccgggttcctccccggggcctacgccctgtctgagccgtcgcttac

SEQ ID NO: 33988 - DNA, 212 bp, Homo sapiens
  misc_feature 9, 14: n = A,T,C or G
ggtgaagcnaaccngcaccccctggtttggcattggaagcaggagtatacccctcatggggacagatgggcacccctttggttggccttccaacggcttcccagggcccccagggtaagtctccttgggttagaggtgaaattcccagaagtgtctaactgtgcaggaatgccccttcccagggatgggaatgactttcagaatcaagaagc

SEQ ID NO: 33989 - DNA, 262 bp, Homo sapiens
gtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaacctggatttatttcttaatatattgggg

SEQ ID NO: 33990 - DNA, 234 bp, Homo sapiens
  misc_feature 14, 17, 31, 34, 36, 42, 51: n = A,T,C or G
ctccccccaggggnaancttccgggcccctntantnggcccngggggaccntgttgaaacccccttttttaagacttttctcaaagttttgaaaagcctattagcccggatccatggtgtaataagaccataaccgtttttccctttaaaaaaatttaagtgccgtgtgtagagttaagaagctgttgtacatttatgatttaataaaataattctaaaggaaaaaaaaaaagg

SEQ ID NO: 33991 - DNA, 469 bp, Homo sapiens
aatgcattccctataaaaactccaataacctttttcacagaaataagaaacaaacctaaaattcatatgaaatgacaaaagaccccaaataaccaaagcaatcatgagaaaaagaacaaagctggagaaatctcactacccgattttaaactctgttgcaaagctgtggtaattaaaacacagtgctggcataaaaatagacacaatgaccagtggaacagtatagaaattccagaaaggaacccatacatctatagtcagttgattttccacaaaggtgccacaaacacccaatgagaaaaggacaagtctcttcagtaaagggtgttgggaaaagtggatatctacatgcagaagaataaagttagacccttatctcacgccacatgcaaaaatcaattcagaatgggattaaagacttttaaacatacctactgaatttgaaaaactactgtaaggaaacataggg

SEQ ID NO: 33992 - DNA, 269 bp, Homo sapiens
  misc_feature 5, 15, 18, 21, 22, 37, 38, 41: n = A,T,C or G
agacnggccacctanaanaanngaccttaaagggganntanttggtagtccttaaaatgccccccatttttaaaaaccaggaaaatatttgaaaatgaagtaaagcaatcagctcaaggaggtagatgaaaacagtattgcccccttgaagtaaatggaaagaaacagtaagtgccagaaaataataacatagaaaacaaaaaaagaagagaagaaatgaaagttaaaagctgagtctttgtaaagactaatgcaatatataaactgat

SEQ ID NO: 33993 - DNA, 392 bp, Homo sapiens
  misc_feature 12, 19, 33, 37, 51, 53, 61, 63, 94, 96, 103, 122, 123, 142,177: n = A,T,C or G
tggttggaaaangccgganctttaaaaaaaaantaanggtgcctggtaacncnagtaaaanantgtaccttggtagcccctgggatagccagancngtgttcnaaccttttttaaaaaaganngtttccctttcctctaganttaaatttcttgggagcaaatgagtattttgttgncatttgttcaattttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcaggtatatcccttcct

SEQ ID NO: 33994 - DNA, 107 bp, Homo sapiens
  misc_feature 2, 8, 13, 14, 19, 27, 28, 40, 67, 71, 78: n = A,T,C or G
cnagggcnaaganntttcnaagtgaannattctcttgccntcacccttagctgcctgcacctgcccnttcngggagangggggtcattaaaggaaactgaacattga

SEQ ID NO: 33995 - DNA, 402 bp, Homo sapiens
  misc_feature 7, 19, 33, 43, 55, 63, 64, 95, 259, 275, 277, 305, 328, 367,376, 381: n = A,T,C or G
accttanacacttttttanttaaatactttgcnccctgggganttggctaaaacnagcttccnngttacctggagatgtccttcaatggaatacnagtcatttccaagaaacctattaaaccttaaagctacctgtagaaaccaaaggggttttcttttttaaatgtttcttggtagattattcataatgtgagatggttcccaatatcatgtgattttttttttcctccccttccctttttttttgttattttttcanactgtgcaatacttananaacctatagcatcttctcattcccatgnggaacaggatgcccacatactgnctaattaataaattttccattttttttcaaacaagtatnaatctagtnggggntgatgcctttttttttcatga

SEQ ID NO: 33996 - DNA, 240 bp, Homo sapiens
ggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 33997 - DNA, 425 bp, Homo sapiens
  misc_feature 6, 317: n = A,T,C or G
ggctgnaggatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctggggacccactgcagataacaatgaagatggtgccaaaactgctttctcctttggttaaagattgggctcccaaagcatttataatttcctttaagttggagactgaccccgccattgtaattaatcgagctcggaaggctttggaaatttatcancatcaagtggtggtggctaatatccttgagtcacgacagtcctttgtgtttattgtaaccaaagactcggaaaccaagttattgctatcagaggaagaaatagaaaga

SEQ ID NO: 33998 - DNA, 147 bp, Homo sapiens
  misc_feature 2, 17, 28, 31: n = A,T,C or G
tncaccccccggggaanctccggccccntantgggccccgggccgccgggaacctgtgtgtgtccctaccccaatggtgcctattcctgtgtcaaaccccctgctgtattttttaaaacatcaattgatattaaaaatgaaaagatt

SEQ ID NO: 33999 - DNA, 315 bp, Homo sapiens
  misc_feature 11, 13, 35, 36, 48, 71: n = A,T,C or G
accttgaaaantnttgacctaaaaacctgggtccnntagaaaattccnggtgggagcctgatttaccctantgacctgaggggaaaaaaaaatcaaattttacctgataatagtaatgcctcccaaatgaattaatgacccatctgttcaataaataaagagcttaaatatacaaaacataagaaatctgggcaacaaaacttgtggtctttacttttgaatagctaccccaagaaaaggttttaaaggtaaaagttatgagtaatgtcatcacaataagctcttgtttaaaattcttttcttttatgtataatt

SEQ ID NO: 34000 - DNA, 372 bp, Homo sapiens
  misc_feature 9, 17: n = A,T,C or G
cggggaaantccggccntttatggcccgggggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacc

SEQ ID NO: 34001 - DNA, 157 bp, Homo sapiens
  misc_feature 4, 13, 29, 33, 51, 54: n = A,T,C or G
attnggccggganagtgtgggcccgagcngatngcctattgtgcctagagngcnaagagttggagttctatcttaggaaaatcaaggcccgcaaaggccaaataaatccttgttttgtcttcacccatgtaataaaggtgtttattgttttgttccc

SEQ ID NO: 34002 - DNA, 371 bp, Homo sapiens
  misc_feature 10: n = A,T,C or G
atattatttntgacatgtaaaaataaatattttcagtttagaagtactaataatacttatgatgattttaaatatggttgtctagatgaatattttctacttctgctttatgttatgcttcatcataaattaaagaagatgtttccttatttgggtgttactaggacatactagcatattacatgtatttttaaagcactatttgagagagtgaatgaattaaaaacgattaaataaaatgagtaaaaaacttgcataaatatagcacaatctgagatatcagtggagatatttcctgaagtccacaaaatttatcgtgaagatgaataaacataatatttcattttatgtcagcacaatttttattagtg

SEQ ID NO: 34003 - DNA, 161 bp, Homo sapiens
  misc_feature 2, 161: n = A,T,C or G
cnactcttagcggtggatactcggctcgtgccgtcgatgaagaacgcagctagctgcgagaattaatgtgaattgcaggacacattgatcatcgacacttcgaacgccacttgcggccccgggttcctcccggggctacgcctgtctgagcgtcgcttgcn

SEQ ID NO: 34004 - DNA, 401 bp, Homo sapiens
  misc_feature 9, 14, 29, 45, 143, 299, 305, 319: n = A,T,C or G
ctccggccntttantggcccggggagagngtgatttctaagccgngaattgtatcagttatgtggaaaccctttgccagaaatacatatacccttgtatattaaatctgagtctcagatttaatcatcgaagcgtagctgggntaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgngaagtnttttacgatagctncataaaaacaattctggtgtctttttgcttgtgctgactttcttggattttaatctacctcatcttgtctttttagagttac

SEQ ID NO: 34005 - DNA, 377 bp, Homo sapiens
  misc_feature 2, 15: n = A,T,C or G
antggcccgggggangtctggcccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggctttggaagaggttttaaatttgctttttttgaggaaaagactgggggtggattttggcatcgtagcatatcgattaaagaataatcaggacatcagatacattttaatacatagctggggccttatgttg

SEQ ID NO: 34006 - DNA, 375 bp, Homo sapiens
  misc_feature 3, 12, 48: n = A,T,C or G
aanctccggccntttatgggcccggggggaaatggcaccagtggaacnaatatttaactaactcagcagaccttcttgcaaatgaaaagaaaactcaaaaggtgccattaaaaagcaatacccattttcaggcaacattattgcaacaaccctttgtgagagaggacactagcttttcaggatatttgaaaaataatataactaacatgctattttatcttaaacagctgtgttcctgtaaaagtgttttggattaagaagggtatttttaccttcatactggagtatgaactccccctgctgttcattagagtatttgcaaagattacaaaagacatcaggtaagggatgtcattgtccccaaaatgaaaatat

SEQ ID NO: 34007 - DNA, 240 bp, Homo sapiens
  misc_feature 2, 44: n = A,T,C or G
ancggaagcaccgtaagccctagttgggggcacctgcatgtganccacaaagctagacaccgtgtgggcctattaacccacatcaaaggcaaatggtaaattgccagccccctttattcaacaagcattactgggctcttactaggtgcaagtctctggatgagttgcggaggactccatgaacacccaggtgagctccctgacctggaggagctgtcacctgtagaagcaggcagatac

SEQ ID NO: 34008 - DNA, 358 bp, Homo sapiens
  misc_feature 1, 13, 52, 290: n = A,T,C or G
nggccaatttatnggccggggggcagaaactggccttccatctctctcaganacccaagctgcagatccaggcttttctgggaaagtgaggccacccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacangggggcggtgcaaaccagtgaacacctttgtgcacgagcccctggtaagatgtccagaatgtctgttt

SEQ ID NO: 34009 - DNA, 455 bp, Homo sapiens
ggaatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 34010 - DNA, 438 bp, Homo sapiens
  misc_feature 4: n = A,T,C or G
accncggggaaattcggccattatggcccgggcaattttaggagcctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgaggggtagaatatattatcttttaaaaattacaaaaatttgtataggcaaaccatttcttaaagttgatggccaaattttaaaatgttatttttcatatcatttataatcttgtcacaatccacttaaagaagtttggttatattttcagtgaaaaattttcttccaga

SEQ ID NO: 34011 - DNA, 385 bp, Homo sapiens
  misc_feature 4, 20: n = A,T,C or G
cccngggaaatttccggccntttatggcccgggggggaaggtagtgacgaaaaataacaatacaggactctttcgaggccctgcaattggaatgagtccactttaaatcctttaacgaggatccattggagggcaaatacctcatcctcaaggaccccaacaagcaggtcatccgtgtctacagcctccctgatggcaccttcagctctgatgaagatgagggaggaagaggaggaggaagaagaggaagaagaagaggaagaaacttaaaccagtgatgtggagctgggagtttgtccttccaccgagactacgagggcctttgatgcttagtggaatgtgtgtctaacttgctctctgacatttagcagatgaaataaaatat

SEQ ID NO: 34012 - DNA, 472 bp, Homo sapiens
cgcagccccgaggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatcccgggcagagggcaata

SEQ ID NO: 34013 - DNA, 302 bp, Homo sapiens
  misc_feature 4, 5, 28: n = A,T,C or G
tgannaatgacattttgaaaatagtccngctctagttgtttttgcagactgaaatttgcattttttgggtcttgtctgtatgattaggttcaggttgaccctttttggcaggagtatcccataggtgatgatgtgtttgtcttcagtattccctccccacagcattttgaagtaaattaaccgaaaggttatccaatattcttacttctacactgacttggtgtttctttcattttaggaaatgccaaacaattggtttaaaccgagatgtaattttaaatatttgaggttgcagtaattac

SEQ ID NO: 34014 - DNA, 113 bp, Homo sapiens
gttggatgtggtggcttgtgcctgtaatcccagcattttgggaggccgaggtgggaggatcccttgaagccaggagtttgagacaagcctgggcaacaaagcaagaccctatc

SEQ ID NO: 34015 - DNA, 220 bp, Homo sapiens
  misc_feature 218: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtnga

SEQ ID NO: 34016 - DNA, 209 bp, Homo sapiens
ggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 34017 - DNA, 297 bp, Homo sapiens
tcccactgctggatatatgcccaaaagaaaggaaatcagtatactgaagagatatctgcactcctacgtttgttgcagcattatttatgatagctaagatttcaaagcaactaagtgtccataaacagatgactggataaagaaaatgtggtacatatacacaatggagtactattcagccataaaaaagaatgagatccagtcatttgcaacaacatggatggaactggaaatcattatgttaagttgaaaataagcccaggcactgaaagacaaacactgcatgttctcacttac

SEQ ID NO: 34018 - DNA, 362 bp, Homo sapiens
ggattccactgagccccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtat

SEQ ID NO: 34019 - DNA, 105 bp, Homo sapiens
aaacatcatctcccttctctttctcgcataactccccacccctttctccccgatccacccaggcctttctgtaaataaaagctcccaagttgggtacaaaccagg

SEQ ID NO: 34020 - DNA, 125 bp, Homo sapiens
  misc_feature 118: n = A,T,C or G
gaggctgaggcaggagtaatagtgtgaacctgggaggcggaggttgcagtgagccaagatggcgccactgcactccagcctgggcaatggagtgagactctgtctcaaaaaaaaaaanttaacct

SEQ ID NO: 34021 - DNA, 386 bp, Homo sapiens
caacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacacctcaaaaaaaggaatggaacgacagtacttcagtccaaaatccaactcgcctccgagaagcatccaaaagcagagtccagctttttaaagatgacccaatgtgaatgtctgtagtca

SEQ ID NO: 34022 - DNA, 405 bp, Homo sapiens
  misc_feature 14: n = A,T,C or G
gaagtcaggccagnagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgccgctcccccagaagtagcacctgctcccaaatcatgggccagtaacaagcaaggaatccaagtgaatagtcagtttcaac

SEQ ID NO: 34023 - DNA, 157 bp, Homo sapiens
gaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagctt

SEQ ID NO: 34024 - DNA, 205 bp, Homo sapiens
  misc_feature 12: n = A,T,C or G
gaatcttagttnactttaaatttgcccacagtaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccc

SEQ ID NO: 34025 - DNA, 348 bp, Homo sapiens
  misc_feature 16: n = A,T,C or G
actggagcaaaaccgnatgactgaaaaatcgagagaaagactagtaaatgggacaggatagcatttacattgtgacttattcacaatgagaaaaatgctgtaattgctgacttggcaaaatgaaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgc

SEQ ID NO: 34026 - DNA, 249 bp, Homo sapiens
  misc_feature 15, 242: n = A,T,C or G
atggcatgttgagtnagttgtcataatggtcagtgagtaaaactaacctactatgacaaacgtgacttacacctctatgtgagcaaacaccttgtgtgtgtgtgtgtgtgtgtgtgtgttaccagcatacaccctagtaggtgcagcctccttcagcaggtatttcctaggctcacaggtacaagtcaataatccctggaactatcaaaagcaaacctttaaaacttatgggaaactcttanatctttc

SEQ ID NO: 34027 - DNA, 371 bp, Homo sapiens
ctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttg

SEQ ID NO: 34028 - DNA, 160 bp, Homo sapiens
  misc_feature 160: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcn

SEQ ID NO: 34029 - DNA, 442 bp, Homo sapiens
  misc_feature 7, 8: n = A,T,C or G
ctcggcnnttatggcccgggattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttat

SEQ ID NO: 34030 - DNA, 457 bp, Homo sapiens
atacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaact

SEQ ID NO: 34031 - DNA, 396 bp, Homo sapiens
aatgaaatctaactattaatgagcatatgtgttttgggatatactttttaaaaaaaatactaatcctctctgtatgtgtaaatcagatgtttagaaataattattcctattagtctataatcatagacatcaaaatcacaagcctgggcaacatggtgaaaccctagctctacaaaaaataaaaaaattagccggcatggtggcacatgcctgtagttccagctactcaggaggctgaggtgggaagattgcttcagcctgggaggcagaggttgctgtgacctgatatcgtgccactgcactccaggctgggagacagaatgagaccctgtctcaaaaaaaatgaaataaaataaaataaaacaaatcaatataatgcacatgctatgagtgatg

SEQ ID NO: 34032 - DNA, 111 bp, Homo sapiens
gcttgtatgcatttccttgattcaatttgtgaccttaccagttttgaattggaattgcaccatttcgtagataaaggaaactaagtatattgctgcacttttaagttttca

SEQ ID NO: 34033 - DNA, 146 bp, Homo sapiens
attgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgc

SEQ ID NO: 34034 - DNA, 475 bp, Homo sapiens
ggcagcagcggaagagacaatggagaagtaaggggaagaagaaagtgtcactggagccaatgcagaaggcaccacagagaccggaaggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgccaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggatgaattcatccattctggctttgcatccggctaccattttcgaagttcaactcaggaaggtgcaatataacaaat

SEQ ID NO: 34035 - DNA, 418 bp, Homo sapiens
  misc_feature 5: n = A,T,C or G
caacnagtgcaagtgaccgacaaaattccgttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagacaacctttctttctgaaatagtcaaatacgaaattagaaaagccctccctattttaactacctcaactggtcagaaacacagattgtattctatgagccccagaagatgaaaaaaattttatacgttgataaaacttat

SEQ ID NO: 34036 - DNA, 149 bp, Homo sapiens
gtacattgaaagcatactatagcaaatatttagttagcagtagttttgagcagtaaaattcatagccataatttagaaatataataattagaaactgaggttaagctttaaaaatcctactaggaaatatttaagaaaccataacattg

SEQ ID NO: 34037 - DNA, 371 bp, Homo sapiens
atagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctccttggacactaggaaaaaaccttgtagagagag

SEQ ID NO: 34038 - DNA, 451 bp, Homo sapiens
  misc_feature 9: n = A,T,C or G
ggaacaagnagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatgtgcctctgggcaaagaagcagagctaacgaggaaagggatttaaagagtttttcttgggtgtttgtcaaacttttattccctgtctgtgtgcagaggggattcaacttcaatttttctgcagtggctctgagtccagccccttacttaaagatctggaaagcatgaagactgggctttttttcctatgtctcttg

SEQ ID NO: 34039 - DNA, 238 bp, Homo sapiens
catagtatattggatacttaaaatttgttataatagtggatcttacatgttctcaccacatggacaaaataggttaactatgtgaggtgatgggtatgttaattagcttgactgtagtaatcattctgcaatgtagatacatatcaaaatgtcacattgtatacctcaaatatgtacaatttttatttaaaaaaatttttccaaattcgatgtatggaccttaatttaatcttcgttc

SEQ ID NO: 34040 - DNA, 153 bp, Homo sapiens
  misc_feature 6: n = A,T,C or G
aatgtnctactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 34041 - DNA, 463 bp, Homo sapiens
gactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacccgctccacctccaagtcaaaagaagtcatgttcaggtaaaactcgttctcgcaaacctctgcagcttggtggttggcactctga

SEQ ID NO: 34042 - DNA, 364 bp, Homo sapiens
ggggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggct

SEQ ID NO: 34043 - DNA, 375 bp, Homo sapiens
ctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtg

SEQ ID NO: 34044 - DNA, 261 bp, Homo sapiens
acggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttg

SEQ ID NO: 34045 - DNA, 374 bp, Homo sapiens
ggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttg

SEQ ID NO: 34046 - DNA, 166 bp, Homo sapiens
gacagcagcgagtactccatctaaaaaaacaaaaagccaaaaaaacccacaaatacctcatggagatgaactgtaataattgcttaaagttccatttaattatgttaactctaatctagcaaaaacatagatgtacttaaaaataaatcatggataatgatttttt

SEQ ID NO: 34047 - DNA, 270 bp, Homo sapiens
ctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattag

SEQ ID NO: 34048 - DNA, 108 bp, Homo sapiens
gtgatgattaagggaggttattactacaacagttcatgaaatgaaagctacctgcttttacccagggagctcttgaaaataaccctctttttccccagtgaataggcg

SEQ ID NO: 34049 - DNA, 390 bp, Homo sapiens
  misc_feature 82, 117, 203, 388: n = A,T,C or G
gttgatgagggaggggaaacttttttttttctatagacttttttcagataacatcttctgagtcataaccagcctggcagtntgatggcctagatgcagagaaaacagctccttggngaattgataagtaaaggcagaaaagattatatgtcatacctccattggggaataagcataaccctgagattcttactactgatganaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaangc

SEQ ID NO: 34050 - DNA, 354 bp, Homo sapiens
  misc_feature 17: n = A,T,C or G
gatataacattcacagnatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaaca

SEQ ID NO: 34051 - DNA, 324 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttt

SEQ ID NO: 34052 - DNA, 357 bp, Homo sapiens
cttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtcgaggaagaaaaacttttttttcataccatgcactatgtaaacagacacattttgctatctgtgtcatcaggatagtgtaagtggtagggtagagactaccctagacatctgcatctttgtaagttagccagacaataaagaaaagcagaatg

SEQ ID NO: 34053 - DNA, 163 bp, Homo sapiens
ggcgcagctcttagtcgcgggctgactggtgtttatccgtcgctcgccgaggttccttgggtcatggtgccagcctgactgagaagaggacgctcccgggagacgaatgaggaaccacctcctcctactgttcaagtacaggggcctggtccgcaaagggaag

SEQ ID NO: 34054 - DNA, 299 bp, Homo sapiens
acaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtg

SEQ ID NO: 34055 - DNA, 116 bp, Homo sapiens
ctactggatcaatgttatctaaatgcatgtgtccagaaagggaaacagaacttactgtttcaggcttgttgtaaagagatggtagatattatctagctagaactcctacacttagc

SEQ ID NO: 34056 - DNA, 217 bp, Homo sapiens
ggcaaccaaaaactgccattgacagaccccaaatggtacatttagaaacagacttcaaggcagctcttaaaaatacgtttggagacttaaaggaaacaatctttaaagaatcaaaggaagacactgacaatacttcctcaaataaaaaaaacataagaaagagaaactatttcaaaagaaccaagtggaaaatctgcagttgaaaagtgcaaacacc

SEQ ID NO: 34057 - DNA, 289 bp, Homo sapiens
  misc_feature 19, 36, 39, 40, 60, 92, 120, 132, 157, 173: n = A,T,C or G
ataaccggaactattatangtaataaatgagggtgnggnntagaatagctgttcctacanacaatgaaaacatgccggcaaagacatgctcntgaaacaaatcaaaattgtaacatattncatcaaacaagntagagagactaagaaaatgatacanagacatgaaagaattngaaaaacaaactctagaaatagaaaaagtcatttaataaatcaagtctaaattagaaggaataggaaagtgaataaacacaattgatatcttaagagaaataccaggtgaaggggt

SEQ ID NO: 34058 - DNA, 472 bp, Homo sapiens
aagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactcccct

SEQ ID NO: 34059 - DNA, 316 bp, Homo sapiens
atagttacatgactaacaaatgattaaaaagaagttattctctagataattttttaaataaaagtactgttaatatataaactaagttattcattcactgtttttcttcacagtaagaatgacaaaaatctgtgttctttgtacttatcaagtgactcaaattttggccacttcactgtcactgatggcttatagaatgactctagcaggactcaagttattgaactatcaaatgggtttttaattgatattgaagtaagtaagttttgtagcttttggagtttttaaaaactacttcagtgattttgatttatat

SEQ ID NO: 34060 - DNA, 154 bp, Homo sapiens
  misc_feature 48: n = A,T,C or G
cgaagaattcacaaaaaaaatagcctcatcatccccaccatcatagcnaccatcaccctccttaacctctacttctacctacgcctaatctactccacctcaatcacactactccccatatctaacaacgtaaaaataaaatgacagtttgagc

SEQ ID NO: 34061 - DNA, 122 bp, Homo sapiens
  misc_feature 4: n = A,T,C or G
cagnatgtaaagaacgcgacttccacaaacctggattttttatgtacaaccctgaccctgaccgtttgctatattcctttttctatgaaataatgtgaatgataataaaacagctttgactc

SEQ ID NO: 34062 - DNA, 370 bp, Homo sapiens
  misc_feature 6: n = A,T,C or G
atattnagtctttttctgcattttcaaatataaaagaaatttaaaatgtggtaattgtgtggccgggcacagtggctcatgcctataatcctagcatttcaggaggctgaggtgggtggattgcttgagctcaggagtttgagaccagcttgggcaacatggcaaaaccccatctctacaaaaatgcaaaaaccagctgggtgagaggtagcgtgtgcctatagtccgagctactcgggaggctgaggtgggaggatcacttgagcccaggaggtcaaggctgaagtgagccatgatcatgccactgcactccagcctgggtgacaaagtgagaccctgtctcagaaaaacaaacaacgccaccccccta

SEQ ID NO: 34063 - DNA, 402 bp, Homo sapiens
  misc_feature 32: n = A,T,C or G
atcgaagatttgccggagaaggaaaaactganaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagc

SEQ ID NO: 34064 - DNA, 357 bp, Homo sapiens
gggacttggcctaggacatgaaaggtgtgctgtaattcctataggcttagtactgaaggaaaaccaattcattccaaccagggtattaggtaggggattaggtgacatttgaacttgtggtagttctttgagggggggttccaaaataagaagcagagatggtctggtcagattgtatttgcctgtaaagaatgctgtttaggcagggtgcgaaggctcacacctgtaacccagcactttgggaggctgaggtgggtggatcgctttaggccaggggtttgggatcagcttggccagcatggtgaagccccgtttctggtaagagtacaaaaattggccgggtgtggtgctgcacgc

SEQ ID NO: 34065 - DNA, 117 bp, Homo sapiens
cgcagtggctcacgcctgtaatcccggcactttgggaggccgaggtgggtggatcacgaggtcaggagatcgagactatcctgtctaacacggtgaaaccccatctccactaaaaat

SEQ ID NO: 34066 - DNA, 134 bp, Homo sapiens
gtatcaagattttcatgttgttttgtcctttattaatatgttgtattaatggacttttgtatattgaattaactttgcattcctgggataatctcagttgtccatgctacataaaccttgttctatgctgctgg

SEQ ID NO: 34067 - DNA, 307 bp, Homo sapiens
  misc_feature 24, 305: n = A,T,C or G
ggggaggctggttgtccagcaagnacagagtgccatgggagagagaaaaaaacatgggaaagatctcagagaccatctagtccagcctcctcgatttggatgggaggagacccaggacaagagagaagtgacttgtccaaggtcacacaacaagtcagtagagagccagagatgggagctgacagcctacttcctcacacctcttcaaggccctcagatacctggtgtccatgacttattagtggcacagccagaccttgattaagggctccaaaattaaaattacctgtccttggaaatgacanga

SEQ ID NO: 34068 - DNA, 249 bp, Homo sapiens
gaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcagcctatataaacctggatttttt

SEQ ID NO: 34069 - DNA, 173 bp, Homo sapiens
gtagaaaagaggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcataattctccagtatatttg

SEQ ID NO: 34070 - DNA, 147 bp, Homo sapiens
aggaacaaacggtcccagtagtcctccggaacccctgcccagggtctctgcaggtctctgccccacgcgttcccgtcgctgacaaagccaccagctgcctcctttaagcttggtgctccggctctgggcctttcttgcgctctattt

SEQ ID NO: 34071 - DNA, 396 bp, Homo sapiens
gagattatgtcttttgggattgtaattgtcaccggtttttgccaactgcctggtctctgtaggcatttgagctttttaaccattcccttagaagtttattttatgcttataaactatggatcacaaatgccatccttatatctgtagttgaatatttacaagatataataaaataagaacatgtgtaatataaattttatgagaattgtttagttaacattaaacaagaaatattttaaaagcgaattttttaaaaggtgtgtttatcattggccaatttctaaagcacgctgtacagactttttccctaaacaaatagaaattctgtaaaatattttaacctatttgcaattaataatggtgttatcacatgaatatttaatccctagacccaga

SEQ ID NO: 34072 - DNA, 238 bp, Homo sapiens
cagattcagaattagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttct

SEQ ID NO: 34073 - DNA, 411 bp, Homo sapiens
  misc_feature 4: n = A,T,C or G
agtnctacatgagatacccctcccatcaaattagtaaaattttaacttttttcattgacatatacaagcttgtaatatattccaaatacaaatctaccaaatatatgtattacagatttaaaaaataattagcaaatatttcaaaggagcgataatatccaccactgcagttagatgaagagatggggggagtctaatacattcctgtggtctttgaacttttgaaaagcaatctggcaaactctattaataaaaaacacagggagatatcatatatgacccagcttttggaagctagcccataaaaataaaagcattgatatgcaagattctgtgtacaggaattttattgcatcattgttgtagggagggaaagaagaatctggaaaccaagcgaatgcccagaaattg

SEQ ID NO: 34074 - DNA, 459 bp, Homo sapiens
  misc_feature 255, 271, 275, 306, 313, 450, 458: n = A,T,C or G
tagatcctacatgcatggttagttgatttttgaaaaatataccaattaaatttaataaggaaggatcgtattttcttaaaagcattatgctaaatgaaagactttagacacaaaataactttttgagtttgtggtgtcaaagtcaaaatataaggattcatctctaaatttaaaaattacaattcaactagtctggtcaaatatgtatagtcatgtaacagccaccacaatcataaaatacaacatttccattgngaaagtccatcatacnactngggtcgttcttgtcatatccaactgaagcanaatcaanaggccaggaggaaaaagcactcaaggtatacaacatcaccccaggcatgtaattatctctgcaagcccagcttctgaaattccttgtaataacctgaaatcagttttatataatagctactaaaacaagctgctganactttaana

SEQ ID NO: 34075 - DNA, 391 bp, Homo sapiens
  misc_feature 6: n = A,T,C or G
gaggcnttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaac

SEQ ID NO: 34076 - DNA, 427 bp, Homo sapiens
  misc_feature 31: n = A,T,C or G
acattattatgggccaagtaggtgaagatgngcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaagga

SEQ ID NO: 34077 - DNA, 393 bp, Homo sapiens
aaaataatttgaaggcgatcttttaaaaagtagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaaggatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaac

SEQ ID NO: 34078 - DNA, 377 bp, Homo sapiens
caagcagaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctgaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaaga

SEQ ID NO: 34079 - DNA, 112 bp, Homo sapiens
gtaaggaaaggttaaaaaaagtaaaaggaactcggcaaatcttaccccgtctgtttaccaaaaacatcacctctagcatcaccagtattagaggcaccgcctgcccagtgac

SEQ ID NO: 34080 - DNA, 256 bp, Homo sapiens
attgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctttattcttgatatagaatatctttcagatattaagggactgattaaatacttgggagaga

SEQ ID NO: 34081 - DNA, 472 bp, Homo sapiens
  misc_feature 13, 19: n = A,T,C or G
ggcaactactttnataatnaccaaattctggaatcctactgccaaattatggcactcatcctacttggtgtaaaatcctgggatgatagcttataatagtaataataagacctgcttcccggtgattctctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaaggggatccgacagctctggaacttgtaatatttgcagcatgtcttgccctcttaatgtctaagaagtcaaaaaaggacacgtatgcctagaaaacatgaataattatcatctatcaaatttttaccatgtgccaagcatagtcatatttggctaacgaaaacaaca

SEQ ID NO: 34082 - DNA, 103 bp, Homo sapiens
attgcccacttagtaacaacttgaataatgccacaaaactgtagataatattccacctctggcagcttcagttgaacaaactctcgatgtaagagaagagagc

SEQ ID NO: 34083 - DNA, 310 bp, Homo sapiens
  misc_feature 13: n = A,T,C or G
gaattattttatncttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccctttctcactctttctctcatcactcacctctgtattcattctgttgtttgggataga

SEQ ID NO: 34084 - DNA, 278 bp, Homo sapiens
aagattacacatgcaagcatccccgttccagtgagttcaccctctaaatcaccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 34085 - DNA, 131 bp, Homo sapiens
cactttggttttcttttttgcgtgtggcagttttaagttattagtttttaaaatcagtactttttaatggaaacaacttgaccaaaaatttgtcacagaattttgagacccattaaaaaagttaaatgagc

SEQ ID NO: 34086 - DNA, 464 bp, Homo sapiens
  misc_feature 3, 10, 17, 20: n = A,T,C or G
agnataaagnacatggnagnactcggatacttgaacagttacaagaaaagagataaggttcaggccagagacataaggagaggcaagatgcagacccaggtaaaatggggacatggtgacacagtgagaggcacattgggaattcagagacagagaacccagaacaagtagacatagggatgtgaacccacaaacacagtcatatggacacaggctagacacagagacagaaacacagggacatgtctggtaagatagaaacaggaacaaggaaacctaaacacatagatcagacagacagaatataagcaaatgggcataaacatgtgacaaagaagtatatccagagaagcaagggtgcaaagacaccgaaccaacatgcacctggcaacaccagaaaaagttacacacagacagacaaccaaggccacaacagaaggcatgggaacagggaatcagaccca

SEQ ID NO: 34087 - DNA, 239 bp, Homo sapiens
ggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatgg

SEQ ID NO: 34088 - DNA, 255 bp, Homo sapiens
  misc_feature 254: n = A,T,C or G
gaagctccttccacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgang

SEQ ID NO: 34089 - DNA, 179 bp, Homo sapiens
gaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatg

SEQ ID NO: 34090 - DNA, 457 bp, Homo sapiens
ggatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctga

SEQ ID NO: 34091 - DNA, 137 bp, Homo sapiens
cagcccaggccagaagacctcccttcaggtgccgggcgcaggaactgtgtgtgtcctacacaatggtgctattctgtgtcaaacacctctgtattttttaaaacatcaattgatattaaaaatgaaaagattattgg

SEQ ID NO: 34092 - DNA, 385 bp, Homo sapiens
  misc_feature 27: n = A,T,C or G
gacgctgcagaatggctcccgcaaagnaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgaga

SEQ ID NO: 34093 - DNA, 339 bp, Homo sapiens
gaaattagcacttttggggccaatggagaaatgcagcattcactctccctgtcttttccctttccctcagcagaaacgtgtttatcagcaagtcgtgagtcaaactgctgccttttaaaagacccacaaaatgctgattcagttcaaaattaatgcaaatgcttcaaaactgagtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatg

SEQ ID NO: 34094 - DNA, 365 bp, Homo sapiens
ggaaagttagatagggtagaggcagaagtagacgcaattaaacatgaaggattgtgaaggcagaagatgaaccagccagcctagtctctggatgcataagctccaagtgtggaggagacccggagagaaaagcagactgttctctgtgtttacctgtaagcacaggccgcaacctgccatgctgtttttaaatgcccaagagctggtgacaagagggtttccctttgccatctggacctgattgccttagagtgaaagtcgacattgcaaaccacagtgacacgtggataaaactcacgttgttggggggagaagagcaaaacatatgcttcacaataaaaacactcagtatcctaggaatagga

SEQ ID NO: 34095 - DNA, 473 bp, Homo sapiens
  misc_feature 19: n = A,T,C or G
agagaactgattttttttnttctagctattttctgaagaacagactgcttacttgccttcagttatcaaatttaaacggcttctaattcttatctgttttttcatttgctcacttggcttttcctgacaatttaattcttgtccactactcataactgaccttcccccatcatctgtgttttgactactgctatgatcatcatcagaaattgtatcaaattgtggtgtgatacagttggtaggtatcccgtggtgttaaacaggtgcaaggtgtggctgaatggaaggggagtgaggctgggttgaagagtggtcccagagcagaccttcagcctggccacaccattgtcagatggctttgtccctctgccttctgttctgctgctaagtgaggaagagcacctcacgagtcacatttcagcaattgtatcactttttcctatcttgctgttgaccaaagtatattgagtgca

SEQ ID NO: 34096 - DNA, 172 bp, Homo sapiens
  misc_feature 132, 147, 169: n = A,T,C or G
ggttgctggatttggtcgcaaagtcatgctgttggtgatattcctggagtccgctttaaggttgtcaaagtagccaatgtttctcttttggccctatacaaaggccagaaggaaagaccaagatcataaatnttaatggtgaaaccnctgtagtaataaattttctttncca

SEQ ID NO: 34097 - DNA, 423 bp, Homo sapiens
caacgagcacaaaattaacaaggctattcaggtacttgaactcagctctggactaagcagacctagtagacatctacataactctccaccccaaatcagcagaatatacattcttctcagaaccacatagcagttactctaaaatcgacctcatagttggaagtaaaacactcctcagcaaattcaaaagaatggaaattataacaaacagtctctcagaccacagagcaacaaaattaggactcaggattaagaaactcactcaaaatggcacatctacatggaaactgaataacctgcttctgaatgactactgggcacataatgaaattaacgcagaaataaagatgttatttgaagccaatgagaacaaagatacaatgtaccagaatctctgggatacagctaaagcagtgtttagag

SEQ ID NO: 34098 - DNA, 257 bp, Homo sapiens
gattgtttcacatgttccgtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagat

SEQ ID NO: 34099 - DNA, 187 bp, Homo sapiens
ataacaagagcctgtctctacaaaaataaaattaaaaaaaaaattagccaggtgtgatgccacatgcctgtagtcctagctacttgcaagcctaaggtgggaggatccattgagcccaggagttcaaggctgcagtgagctgtgatgttgccgctacactccaggtgacagagcaagaccctaagac

SEQ ID NO: 34100 - DNA, 389 bp, Homo sapiens
  misc_feature 304, 346: n = A,T,C or G
cttgtgattgcaacggacaataaagtttggggtctagactgtgatgtcctgttttctagcaatattccgctgtagttcccgccactttgttttctaaactcttttttttttcctgggctgcttgaccccatttccaagctgccacctggggttcctgggtaacctcaattcctcatctctatcaaaactgaaggacttacaagaccttgcgctaacctaacattaaaaggaaatcttaactctaggaatggggagacctttgtaactgttttcatgttctcctgccatctggttcatcaccganaagtgtttggccgttaagaacacgaaagaaagagatagagtntcaggttatgctcttaaaaaaatacattctaaaaagacaacct

SEQ ID NO: 34101 - DNA, 381 bp, Homo sapiens
  misc_feature 9: n = A,T,C or G
atctaaagnatcttttattttctcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagaga

SEQ ID NO: 34102 - DNA, 282 bp, Homo sapiens
ggctgggtggggtggctcatgcctataatcctagcactgtgggaggcagaggtgggtggatcacctgaggtcgggagtttgaaaccagcctggccaacatggtaaaaccccatctctactaaaaatacaaaaattagctgggtatgggggcacatgtccgtaatcccagctacttgggaggctgaggtaggagaattgcttgaatccaggaggcggaggttgcagtgaaccaagcttgcaccactgcactccggcctgggagacggagtgagactccatctc

SEQ ID NO: 34103 - DNA, 263 bp, Homo sapiens
aacaaagcttcaactgcattcctactgtggagtccgaaaaaggtagagaggtataaatgatacattcaaactgtgatttttgtgaacagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaac

SEQ ID NO: 34104 - DNA, 308 bp, Homo sapiens
gaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggtt

SEQ ID NO: 34105 - DNA, 156 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctt

SEQ ID NO: 34106 - DNA, 458 bp, Homo sapiens
ggcgcaatagatatagtaccgcaagggaaagtatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 34107 - DNA, 289 bp, Homo sapiens
taactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 34108 - DNA, 267 bp, Homo sapiens
  misc_feature 29, 254, 261: n = A,T,C or G
gggggttggtctggcctactgggctgacnttaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagttttttttttagngtagganaaatac

SEQ ID NO: 34109 - DNA, 162 bp, Homo sapiens
  misc_feature 4, 35: n = A,T,C or G
aacncagcttctattatgcctttttctaacacagnactttcttcactgtctttcatttaaaaagaaattaatgctcttaagatatatattttacgtagtgctgacaggacccactctttcattgaaaggtgatgaaaatcaaataaagaatctcttcacatg

SEQ ID NO: 34110 - DNA, 198 bp, Homo sapiens
gtgcctgcagccccgtggactgtctgtttttgtaacacttaagttattttatcagcactttatgcacgtattattaacattaatacctaatcggcgagtgcccatctgccccaccagccccagtgcgtgctgtctgtggagtgtgtctcatgctttcagatgtgcatatgagcagaattaaacatttgcctacaactc

SEQ ID NO: 34111 - DNA, 467 bp, Homo sapiens
  misc_feature 29: n = A,T,C or G
ggtaggagcctctctccctactgctgctncacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggct

SEQ ID NO: 34112 - DNA, 289 bp, Homo sapiens
  misc_feature 30, 31: n = A,T,C or G
ggcggaggtcagggacaagatggtgccacnngtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgt

SEQ ID NO: 34113 - DNA, 163 bp, Homo sapiens
  misc_feature 163: n = A,T,C or G
gtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcn

SEQ ID NO: 34114 - DNA, 369 bp, Homo sapiens
gacacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacaccattcagtcactagttggatggcacaaggctcttcacagacgcatctgtagctgagtggaacttgtactaacttatgatagaatgtatcagaataaatg

SEQ ID NO: 34115 - DNA, 280 bp, Homo sapiens
  misc_feature 3, 42, 44, 116: n = A,T,C or G
ggnatgaggaggcggcggttgcaaggcaagtatgcctgtggnangtaaagaaaggaaagaaggctgctgttggtgttaagaagcagaagaagcctctggtgggaaaaaaggcagcngctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagac

SEQ ID NO: 34116 - DNA, 170 bp, Homo sapiens
ctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcac

SEQ ID NO: 34117 - DNA, 320 bp, Homo sapiens
  misc_feature 1: n = A,T,C or G
naacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatgtttaatgatgattatggagccttagaggtctttaatcattggttcggctgcttttat

SEQ ID NO: 34118 - DNA, 442 bp, Homo sapiens
  misc_feature 21, 31: n = A,T,C or G
ggggcgacaacgtggcacagnaacggcactncatcggagtaggcacactgcaaagacgagacgagtcctccccagagaggggaggcggttaaggagaggagattgcgtggctcggagcagccagacccgatggtgtgcttctcacctcagcgtgatagcctgaccttgactcctgagttccacgatcgcttcacaactgcaagtcaccatcatacaaaatttgagtttccctaagtccgcgcctttgagagctttggaacgatatgcaagttcaagtcaccatcctgtttcttgctacctcctgtgagaagaccaacatttgggttacacttgtttctactcttgttcttctgcttgttattgttgcctctgcagccattgatcacacacgtgttgtcatacaaaaactggttagcctttttatttgtcttgtgaattttat

SEQ ID NO: 34119 - DNA, 158 bp, Homo sapiens; identical to SEQ ID NO: 30320

SEQ ID NO: 34120 - DNA, 226 bp, Homo sapiens; identical to SEQ ID NO: 14144

SEQ ID NO: 34121 - DNA, 325 bp, Homo sapiens
  misc_feature 22, 31: n = A,T,C or G
gagggtttaaatattgaggatngtgcaaggngaatcttcaaggtattcgaatttttctgtatctcagcaggggtggtggctcacacctgtaatcccagcattttgggaggctggggcgggcagatcacttgaggtcaggagttcaagaccagcctggccaacatggtgaaacccccatctctacttataaaaattagctgggtgtggtggtaggtgcctgtaatcccagctactcgggaggctgaggcaggagaatcacttgaacccgggaggcagaggttgcagtgagcccacaacttgggcaacagagcaagactctatccca

SEQ ID NO: 34122 - DNA, 182 bp, Homo sapiens
  misc_feature 31: n = A,T,C or G
ggctttggtgactctagataacctcgggccnatcgcacgccccccgtggcggcgacgacccattcgaacgtctgccctatcaactttcgatggtagtcgccgtgcctaccatggtgaccacgggtgacggggaatcaggagttcacaacagcctgggcaacatggcgacaccccatctctac

SEQ ID NO: 34123 - DNA, 321 bp, Homo sapiens
agaaaagaatgtggggagtttatctcactagcttgtttacccatgtggtcctaagactaacctttgatttaccgggttcttaattgctttctactggggaggtttgcaatatcaattaccctctagtggtgttgactcaaggctttgtcaattaatctgtactgaataaatgcgagtctcactggctcgtcgaggctgctgtctgcaactgtttacagcactgttcttggagtctgtaagtggcccagatgcttagccagactggcaaagcagaatatctgtgtcggtgtactttattcatccgtcattgggtcagggtct

SEQ ID NO: 34124 - DNA, 328 bp, Homo sapiens
caggattaaaggtattataaatcctcatagcggaacatttctcagggcaaaggaacctggctcatttgaagattaatgttccatgcctttgtggtcaaacggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaggaac

SEQ ID NO: 34125 - DNA, 280 bp, Homo sapiens
  misc_feature 7, 31, 33: n = A,T,C or G
ggaatgntgatcgcctttcagtacgtgctgntnatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgaga

SEQ ID NO: 34126 - DNA, 287 bp, Homo sapiens
  misc_feature 12, 17, 68: n = A,T,C or G
tatggaacgggnaaaanaaagtttttaagttataactttggattatattccagaagttaaggtttgancacaagaaaaaggatagcttattgtacagggcttatcattatgtttctttattatttaataaaaaaccaaaattctgttgtcttaattgtttctttcttctacccctaaagattcctattctagaaataaaattgaagatccttccagttcttggatttctaggtggagtaatattttcctgttcaaattatttccatgttatcctccatggtggtgtt

SEQ ID NO: 34127 - DNA, 365 bp, Homo sapiens
  misc_feature 30: n = A,T,C or G
ggaggccctgggtgactttggaagtccgtnttgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatga

SEQ ID NO: 34128 - DNA, 327 bp, Homo sapiens
  misc_feature 3: n = A,T,C or G
atntttgtcttttttccgtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatg

SEQ ID NO: 34129 - DNA, 280 bp, Homo sapiens
gaggtcctagagtctctcttccgcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactg

SEQ ID NO: 34130 - DNA, 228 bp, Homo sapiens
  misc_feature 224, 226: n = A,T,C or G
ctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagggatgaggcggatgangnga

SEQ ID NO: 34131 - DNA, 110 bp, Homo sapiens
tcaggcaggctgaggcaagagaatcacttgaaccctggaggcagaggttgcagtgagcagagatcgggccattgcactccagcctgggtgacagagtgagactctgtctc

SEQ ID NO: 34132 - DNA, 372 bp, Homo sapiens
agagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcaga

SEQ ID NO: 34133 - DNA, 182 bp, Homo sapiens
caatgagaatcttctgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatct

SEQ ID NO: 34134 - DNA, 352 bp, Homo sapiens
ggagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatg

SEQ ID NO: 34135 - DNA, 103 bp, Homo sapiens
  misc_feature 6, 9, 32, 44, 66, 73, 78, 88: n = A,T,C or G
gaaacntcnattcatattagcgttgtgctgantgaaagactgtngacacaaaataactttttgagnttgtggngtctncgtcctaatntaaggattcatctct

SEQ ID NO: 34136 - DNA, 111 bp, Homo sapiens
  misc_feature 6, 21, 31: n = A,T,C or G
tacttngtgtgatcaaaaagnaagagttaanacaacacatgtaaatgccttttgatatttcatgggaatgcctctcatttaaaaatagaaataaagcattttgttaaaaag

SEQ ID NO: 34137 - DNA, 142 bp, Homo sapiens
  misc_feature 25: n = A,T,C or G
attggggaataagcataaccctganattcttactactgatgagaacattatctgcatatgccaaaaaattttaagcaaatgaaagctaccaatttaaagttacggaatctaccattttaaagttaattgcttgtcaagctat

SEQ ID NO: 34138 - DNA, 295 bp, Homo sapiens
gtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtga

SEQ ID NO: 34139 - DNA, 258 bp, Homo sapiens
ggacacctggtctttccctgagttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggat

SEQ ID NO: 34140 - DNA, 170 bp, Homo sapiens
  misc_feature 7, 15, 25, 27, 56, 106, 132, 140, 155: n = A,T,C or G
gagtgtnccgctgtnctgtctggcncnaacaccttcagggactggagctgctttcntccttggaagagtgttcccagttgaagctgagaagcacagcacagtgcanctgtggttcatattcaggcatctcangagaactncggaagagcttgatngggccaaatgtgcga

SEQ ID NO: 34141 - DNA, 178 bp, Homo sapiens
  misc_feature 6, 32: n = A,T,C or G
catcantaactcagtgggctgacccatccctnccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccatcc

SEQ ID NO: 34142 - DNA, 393 bp, Homo sapiens
atctggggaaaggaaaaccggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaata

SEQ ID NO: 34143 - DNA, 471 bp, Homo sapiens
  misc_feature 157: n = A,T,C or G
atttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcangatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatggga

SEQ ID NO: 34144 - DNA, 250 bp, Homo sapiens
  misc_feature 55: n = A,T,C or G
atctctgaactacctttgtatccaacatgttttaaatccttaaatgaattgcttnctcccaaaaaaagcacaatataaagaaacacaagatttaattatttttctacttggggggaaaaaagtcctcatgtagaagcacccacttttgcaatgttgttctaagctatctatctaactctcagccccatgataaagttccttaagctggtgattcctaatcaaggacaagccaccctagtgtctcatgttt

SEQ ID NO: 34145 - DNA, 469 bp, Homo sapiens
aatgatacttagtttttgtaccttgtatcaaggtgcagtatgctggtgattattttttagagcacggaaatgccagcggtagtaagcaaatctcaaactgtcagcttagaggtttattgtgcgtgtctgctctttgagtctataaagggattaacagctgaatatagactttaaatcactgttgggatttaaatttttactctgaaagactaggtcatttgacagtaatcaagggtattttcattctcaagactgttttgcaggcccagcagaaaacccctctatttaacccatgaggggagtcatcctcagggctgaggcatatgaaatctggggtacttcacacagaaaaataataaaaatgtagggggatttgccttgtggttgaatccaggaagttctaaattggcaataagcagatagggaacaattttgtcagatactgtggattaatggtatttaaaaggca

SEQ ID NO: 34146 - DNA, 267 bp, Homo sapiens
atcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgct

SEQ ID NO: 34147 - DNA, 156 bp, Homo sapiens
agtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacctgttttcagc

SEQ ID NO: 34148 - DNA, 473 bp, Homo sapiens
  misc_feature 23: n = A,T,C or G
attttaagttattttcctttttnttggcaattagttaacatgtaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtaagagattctggaattgtctatttttatgaattccattattttgtccatggcatctctaatgaaaacaggttctagaataaaggagttgattagtctgaacagtactaattaactacaaaataaacgtta

SEQ ID NO: 34149 - DNA, 468 bp, Homo sapiens
aacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatag

SEQ ID NO: 34150 - DNA, 339 bp, Homo sapiens
atagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattccacagctcaccatttgactactacccaattatgtccaaaaaaagggaagaaattaacatctctcccaagcaggaaagggaatatcaggaagactttagga

SEQ ID NO: 34151 - DNA, 473 bp, Homo sapiens
gtgtcatatatttttaagacgaatgaaattcaagatggttgcagtggtaggataaacaactctaacctagtgtgtgtatcatatacagctccctataaattacactatacatgaccacactaacgtgaacattaatttagcaaactctccacctttgctcatcttgactcctcatctagaatgtctcctgtgtttgattgttaaattatacaccttctttatactctctcctccacagcgccccttctctgattcctgtaaacaagcagagagcacatcacaactctgtgaagaagattctttgggctataaagatgaagagtctacttcttctggtgctgatttcaatctgctgggctgatcatctttcagacaactatactccggatcatgacagagctattcacatccaagcagaaaatggcccccatctacttgtggaagcagagcaagccaaggtgttttcacacaga

SEQ ID NO: 34152 - DNA, 160 bp, Homo sapiens
  misc_feature 4, 140: n = A,T,C or G
gaantctggttaggctggtgttggggttctttgtttttggggtttggcagagatgtgtttaagtgctgtggccagaagcggggggagggggggtttggtggaaattttttgttatgatgtctgtgtggaaagcggctgtncagacattcaattgttattg

SEQ ID NO: 34153 - DNA, 467 bp, Homo sapiens
tacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgggatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 34154 - DNA, 488 bp, Homo sapiens
  misc_feature 5, 27: n = A,T,C or G
gagancggccgatctccagcccaagangattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacacccagtggttcctcctccctgttaaagactaatgctcagatgctgtttacggatatttatatt

SEQ ID NO: 34155 - DNA, 377 bp, Homo sapiens
  misc_feature 3, 26, 307, 337, 339, 367, 370: n = A,T,C or G
tgnggagattcgctgacttccttggntaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgnagaagctaagtagaacacttagtttggggngncaattttctatcaacgcaaacaccttanggnacccaga

SEQ ID NO: 34156 - DNA, 500 bp, Homo sapiens
  misc_feature 5, 7, 64: n = A,T,C or G
acacncntagtcacagggtttcacgttgtaacactcactgtttcttcctggaatagcttggtantcattgatgttcagatggaatctagttaaaatgagattagttattttggataggtggagaaaaagaaaaaatgctttgtggtaacttggaggtttctcccccctagaaatttagaaagaaaaatgttgctgctactctgagatatatgaatgatttttcagtgttaaaaacagaactttgcaagttgtttgaagagggttggtgaggtgggggagggggctgggtggtggaaaggaaagctattttgaaaatgttaaatgaaaccaaaagtgcagttttaaaaatgagaacttccaaactctcttatttttcaggatctctacatggcctcagaaaaccaattgtaagactcttatactgattttattttccttgaagtcttttttttcccccattttcttactatgggaactgtttttaattaaaaattgctgca

SEQ ID NO: 34157 - DNA, 268 bp, Homo sapiens
tatggtgactcccacctgtaatccgagcactttgggaggccaaggtggaaggatcacttgagtccaggagttcgagaccagcctggacaacaaagtgagaccccatctctacaaaaaaaaaattgcaggcatggtggtgcagacctgtagtcctagctactcaggaggctgagctgagaggattacttgagcccaggaggtcaaggctgcagtgagtagtgatcacagcactgcattccagcctaagggaaaagcgagaccctgtccc

SEQ ID NO: 34158 - DNA, 464 bp, Homo sapiens
gaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttgtttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggaggtttcagt

SEQ ID NO: 34159 - DNA, 196 bp, Homo sapiens
  misc_feature 2, 17, 29, 30, 34, 36, 49, 59, 62, 65, 73, 77, 88, 108, 110,132, 152, 176: n = A,T,C or G
gngactcccacctgtantgccgagcacanntgtnanacccaggaggaangatcacttgngtncangagttctnagancagcactgganaacatcagtgagaccccatntntacaaaaaaaaaattgcaggcntggtggggcagacctgtaancctagctactcaggaggctgagcngagaggattacttgagccca

SEQ ID NO: 34160 - DNA, 299 bp, Homo sapiens
  misc_feature 6, 14, 27: n = A,T,C or G
atggcncggggcancgcgctcaaaacnaggctgttgggcccatgctgtgggcggccagccaagagctagttttgtttcttccccctccagcctctctctctctccctcttattttttttccccctaaaccaaagggaattcctaataaagccacagcagacttgtagagagcaagggaaaggaagaaggaaccagaggtggggaaaaaacagatgaaactcattgctttctggaagtccagaataaagaatatatatgcatataaaattatagcacacttcaccatatgcttcgaaact

SEQ ID NO: 34161 - DNA, 318 bp, Homo sapiens
  misc_feature 97, 99, 152, 213, 226, 251, 262, 276, 311: n = A,T,C or G
aaaaaggtgattttctaaagtctcatattaaatatttataaacaggattagatttcaagtctttcatttttttttttactctggggcctaacctagngngaagtcttagttcacatccttgaattgatttgatttcttattattcaagaagngaattattcactcttactctgtacatttcactggctgttaaacctttactttaaaggtttnggaaattactacncattaaaaaaaagaagaagaagaantgaagataaancctttaaaggtttnggaaattactacagatttaaaaaaagaagaagaantgaagat

SEQ ID NO: 34162 - DNA, 185 bp, Homo sapiens
aggttgagttctgtactttaaaaatcaggggattcagccaggtgtggtgactcatgcctgtagtcccagtgctttgggaggcagaggtgggaggatcgcttgagccaatgagttcgagaccagcctgggcaacatggtgaaaccctgtctctacaaaaattaaaaaaaaaaaaccaaaaaaacct

SEQ ID NO: 34163 - DNA, 100 bp, Homo sapiens
  misc_feature 2, 6, 49, 50, 51, 52, 56, 60, 63, 64, 66, 68, 71, 75, 88, 93: n = A,T,C or G
gngggngggggttttttccccggggaattcgctcctttatggcccgggnnnntganctcntanngnantgnaganccaattctgaganccggnaggaatg

SEQ ID NO: 34164 - DNA, 471 bp, Homo sapiens
  misc_feature 3, 6, 377, 395: n = A,T,C or G
aangcntgttgcatttgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgctaaatggttttgtccttaaataggagaggctcaaaaacatcaagatttcaggaaaatggcgacagctgcataatggaacccccctgcttctattttgttcttttaattactatttatagccccagttaccttctgaattctgaagtgtatatacctccatgttcctgaaaacaagaaaactcttacttcctgatattccatagactgccttcccaggngattgagaacatagagantgttacacattttattttactctaaatgatcttttacccctgttagctaatctttgggttttcctcaactttatta

SEQ ID NO: 34165 - DNA, 500 bp, Homo sapiens
  misc_feature 4, 8, 28, 31, 33, 43, 89, 90, 92, 101, 120: n = A,T,C or G
taanatanaataatctgggtgccacaanagnanctgtaatatncttaatacatctaatgaacccacccaatggaaaaacgctgagaatnngncatgaaagncacaaataaaacacgtgcngatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatc

SEQ ID NO: 34166 - DNA, 394 bp, Homo sapiens
  misc_feature 15: n = A,T,C or G
ataaatctaatgctngaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttg

SEQ ID NO: 34167 - DNA, 473 bp, Homo sapiens
  misc_feature 26, 60: n = A,T,C or G
gacataatagagatagaaagcacagnaaggagcgtggatcggaagagaagggatacttcnggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataat

SEQ ID NO: 34168 - DNA, 277 bp, Homo sapiens
  misc_feature 147, 276: n = A,T,C or G
aactaggttgagtttttctcctctgctgaggaaacagtaccgaagttctttttcttgtggcatttgtattataaaaacttggtgtgggggaggagcacaaaactccagcccactgaacctctgccaattaagatggtgttgggttanggttacatctggttactgtcctgggaaaatcatttttatagagatggccttccaagtggttttaaaatttactgaagcttttaggtcaattatgtatgttgactaaatttacaaataaacttgtttatnc

SEQ ID NO: 34169 - DNA, 482 bp, Homo sapiens
  misc_feature 4, 20: n = A,T,C or G
aganctaaggaatgtttttntaaatatatacatataaaataatgtaaagatttagtaactcttttatcaatattctaaggattagaatgtatagtagaatagtcttttatgaaataatatacttatggaaaatatatgactggtatatgattcctttagaggaagaaaatttcaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatactaaggttggctattacgtgtattaagcgtttccaagcgagtggtcttggctggggtgagattgtcagctgtctgttaggattagtcacaacaaacatggtgcaaatggtttccaacaacagcgcacttcaaggttaccttcataattctttt

SEQ ID NO: 34170 - DNA, 304 bp, Homo sapiens
gaaaaaccaaaaatcttggaaaactaagacgggtcttgtttaaaatgtctctcagctttggcaaccttcaaatcttaatcaactatttaaagcattactgtgtcttgtagcctgcattccacaacagctctgctattcaggtaaaagacttgaactgagccgtttgggacctatactgtaatattttcattgaggaacaatatcctattttgtaaagcatttccctatgtgtgactttaaactgtaaaattaaacactgcttttgtgggttcagtgggcataataaatataaattgtaaactag

SEQ ID NO: 34171 - DNA, 323 bp, Homo sapiens
  misc_feature 5, 20, 60, 61, 67: n = A,T,C or G
gtgtncattgagtgggcttnagagaagtgtgcccctcaggctcttaaagagaccggaagnnctgcantgaaggagatagaaaactccagatatgtgcattgataccaggctcaacaaagctgtctgggccaaagtagtaaggaatgtccatactgtgtccatgtgcagtggatggtccagaaaacataatgaggttagaaattcaccaaataagctctatactttggttatatacttgttaccactttcacaaatctacagtcagtgtggatgggaactaactgctgatcatcaaatacatcaaatgaagttataaaaactac

SEQ ID NO: 34172 - DNA, 366 bp, Homo sapiens
  misc_feature 13, 19: n = A,T,C or G
accatcagaattnatattncctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaagaatattgacatgagc

SEQ ID NO: 34173 - DNA, 103 bp, Homo sapiens
  misc_feature 9, 25, 89, 98: n = A,T,C or G
gttgcctanggaggggaggatacanttcaagataccccagcctggagtcagggccagggaggcactggccccacttgtatccagaagtncccaggggngattg

SEQ ID NO: 34174 - DNA, 268 bp, Homo sapiens
tgtttaccaaaaacatcacctctagcatcaccagtattagaggcaccgcctgcccagtgacacatgtttaacggccgcggtaccctaaccgtgcaaaggtagcataatcacttgttccttagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaac

SEQ ID NO: 34175 - DNA, 312 bp, Homo sapiens
  misc_feature 2, 4, 13: n = A,T,C or G
cngntcacgaggngggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcat

SEQ ID NO: 34176 - DNA, 465 bp, Homo sapiens
  misc_feature 24, 43, 407, 408: n = A,T,C or G
ggatgaaattgaaaagtaccaagnaagtggaagaagaccaagnacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaagtggaagaagaccaagacccatcatgccccaggctcagcagggagctgctggatgagaaagagcctgaagtcttgcaggactcactggatagatggtnntttcgactccttcaggttatcttgaactgcctgacttaggccagccctacagcagtg

SEQ ID NO: 34177 - DNA, 472 bp, Homo sapiens
cacaatcacaatgaacatgtcaaggaagaatttgcggagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatatttttcttttctttatttattctctgtaag

SEQ ID NO: 34178 - DNA, 254 bp, Homo sapiens
  misc_feature 9, 78, 122, 126, 213, 215: n = A,T,C or G
gttttaggnaatttccttggtaccagcatctcattggattttggattttgacccattttccaggtctatttttcaatnggaaactttcacacatttgcatgggaatatgttcattccatgtngtanagtaaaacataacaggttatggcaaagcagcatatttaatatcagctcacatatgtaggataaaattccaaactttgtgtgtgtgcngngtgtgtatacatacatccatataacatatatcacaaact

SEQ ID NO: 34179 - DNA, 427 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaaagttgtagggtgatt

SEQ ID NO: 34180 - DNA, 470 bp, Homo sapiens
  misc_feature 12, 29: n = A,T,C or G
aagaaaaaaagnaaaagaaacaccagganaatttttactagcaatataatttgtaggtgcagtaaatgtgaagaaatatttaggctaaaattaagactatgtaaacatcagaggatttacagtagaaagaactaaggaactaacacttcagactttaaaataaatcagagtattaagtataacaaaagttgaacctgttagaaaatttccttgtatataagttgaaaagtaggtttttgaagagatatattcgaaatatattttttcacttgaaaaaagtaaaaatttttttcaaaggcaaataattcaactctaaaattatactatttcaacattctcatttatgtgaaagcatgtgataaattgttgctgcgtcagagatatgagaaattcctttgcattaggtgggcattattcatagacttctacatgaaagagaagagaaataaaagatgcaccaggaaaatctg

SEQ ID NO: 34181 - DNA, 210 bp, Homo sapiens
  misc_feature 2, 210: n = A,T,C or G
gngaaggtgaaagtatatgccctaaagtggataaaacctccatggataaaaatgtgaagagaaaaaaaagtagaaggctaaggacttaccatcatttaaatacccactttcaggagctggcaaaaaacacagaaaaggatccagagagatagaagaacaagatatcatggaggaaataagcataaatgtccaacagaaatctaggatgcn

SEQ ID NO: 34182 - DNA, 482 bp, Homo sapiens
  misc_feature 458: n = A,T,C or G
gtaagataggattttctgtgtttcctgaattttttatatggtgatttgtatttaaattttaagacttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagntgcatttcagagagttctctcaat

SEQ ID NO: 34183 - DNA, 334 bp, Homo sapiens
  misc_feature 9, 10, 47, 59: n = A,T,C or G
tctaatagnngctgcgatatagaaagaaaaaataagaagcaaaatanaccccagcactnctccctttaaccagaactaatgaaagaagtgacaaatttgctccaagattaactaaaacattcaaagagacttacactggcacaacacccatttgtcacctaatgtatgcagtaaacgtgcagagttttctaggatatgttttaaccttctctccagctccccactcctgcagtcaaaacctaggaagccaatcatttattaatattactatatttatgtggacaacatactcattggtaagaaaaaaaaaagcaatctctgaattcctttctag

SEQ ID NO: 34184 - DNA, 428 bp, Homo sapiens
  misc_feature 7: n = A,T,C or G
gggaagngacggagacgtgctagcgcgtcgaaggtagctctatggttttcctcgcgttcttgagtcgggaaatggccgctgtgtggttgcaacggagataaattcccggaaccgcgattcggcgtgtcaaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattac

SEQ ID NO: 34185 - DNA, 241 bp, Homo sapiens
  misc_feature 7, 13: n = A,T,C or G
gaagggngtggtnagcagtgggtcaggaagtggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggat

SEQ ID NO: 34186 - DNA, 384 bp, Homo sapiens
ggagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggc

SEQ ID NO: 34187 - DNA, 130 bp, Homo sapiens
  misc_feature 50, 99, 112, 122: n = A,T,C or G
ttattatgctagttctagtgatctgcaatcagtatcagaactatcccaangagtgatctgcatttcagtttataaagaattatgctgatatagcctgangcttgttgtaganattagctatntaaatcaa

SEQ ID NO: 34188 - DNA, 434 bp, Homo sapiens
  misc_feature 425, 428: n = A,T,C or G
agagtgagactatgtttaataaaaaaagtttctagtaaaataaaaatgtcttcaaaatttatacatttatacatttggtctaaattaggcaagtcagatactatgtttactaaactacattaactgcttcattgtcttttgataatttctcaacttacctgctttggagcaattagattctatgtaaggcctactgatggacataggttgttagccatgtccccggctttgctggaaagagtcataccttatttgtacttctatcctgatgttctaggctctgcacctggtacataattaacataacttaccaggtttttttaccaaaaataaaagttgctaatagttaacattgtaacatatataattggaaactactgaaggaaggagttttacatgcaaggtgtgtaaagaaagtagaatgnggntttttg

SEQ ID NO: 34189 - DNA, 463 bp, Homo sapiens
gaaaagggcatgcctgtgacagctcgtgtggtgtttgtttttggtcctgataagaagctgaagctgtctatcctctacccagctaccactggtaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatttggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagttca

SEQ ID NO: 34190 - DNA, 334 bp, Homo sapiens
  misc_feature 32: n = A,T,C or G
gattgcagaaactggccttccatctctctcanacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctg

SEQ ID NO: 34191 - DNA, 465 bp, Homo sapiens
  misc_feature 9, 106: n = A,T,C or G
accgaaatnaagatggagactttaagaacctgaagaaccttcacgcattgattcttgtcaacaataaaattagcaaagttagtcctggagcatttacacctttggngaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggcta

SEQ ID NO: 34192 - DNA, 472 bp, Homo sapiens
  misc_feature 2, 18, 28, 32, 35, 39, 43, 48, 49, 61, 83, 94, 97, 102, 104: n = A,T,C or G
tncttcccgggctagacntcgccctttnatgntgnggcngcgntgtanncgataccgtgcntgctgcggtgggagccgctcancaaaatgctgnatnttcgngnaaacccttacgggggaagaccatcaccctcgaggttgaaccctcggatacgatagaaaatgtaaaggccaagatccaggataaggaaggaattcctcctgatcagcagagactgatctttgctggcaagcagcttggaagatggacgtactttgtctgactacaatattcaaaaggagtctactcttcatcttgtgttgagacttcgtggtggtgctaagaaaaggaagaagaagtcttacaccactcccgagaagaataagcacaagagaaagaaggttaagctggctgtcctgaaatattataaggtggatgagaatggcaaaattagtcgccttcgtcgagagtgcccttctgatgaatgtggtg

SEQ ID NO: 34193 - DNA, 124 bp, Homo sapiens
aatgccccaactaaatactaccgtatggcccatcataattacccccatactccttacactattcctcatcacccaactaaaaatattaaacacaaactaccacctacctccctcaccaaagctc

SEQ ID NO: 34194 - DNA, 164 bp, Homo sapiens
  misc_feature 161, 162, 164: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccnnan

SEQ ID NO: 34195 - DNA, 129 bp, Homo sapiens
  misc_feature 24: n = A,T,C or G
gcatatttgaatttttcatgcagnttttctagagcaataatcagtggtgcctttgtacctaggttttatgtgattttaatgaagcatggatagttgtggccacctgctgactatttgtggtttaaaata

SEQ ID NO: 34196 - DNA, 375 bp, Homo sapiens
  misc_feature 7, 16, 32, 373, 374: n = A,T,C or G
cagcatnaagactgangttggaatattctgtngaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcaagtatggatgtgtctgaatgtgtgaggccttggaagggactctttctgcagatactgtaaatacaagtaccattttaataaagcatgtacnnt

SEQ ID NO: 34197 - DNA, 171 bp, Homo sapiens
  misc_feature 9, 11, 17, 23, 24, 26, 27, 29, 31, 33, 42, 116: n = A,T,C or G
gagtcatanantcgacngggccnngnngntnanctgcacatnattatccttctgttcttagatctgtatcttcataataaaaaattttgcccaagtcctgtttccttagaatttgngatagcattgataagttgaaaggaaaattaaatcaataaaggcctttgatacctt

SEQ ID NO: 34198 - DNA, 413 bp, Homo sapiens
  misc_feature 15, 16, 30, 33, 40, 56, 64, 74, 79, 80, 86, 87, 88, 97, 98,100: n = A,T,C or G
agcgcgccattgagnntgggctcggggaanctnggaattnatgcggaagcatgganctggtatnacacacaganaaganngtgctnnngggacagcnntnctgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtatgaggaaaaaaccaaatgaccgcactgtgatgtgaatggcaccgaagtcagatgagtatccctgtaggtcacctgcagcctgcgttgccacttgtcttaactctgaatatttcatttc

SEQ ID NO: 34199 - DNA, 318 bp, Homo sapiens
  misc_feature 7, 11, 44, 50, 54, 55, 56, 59, 62, 317: n = A,T,C or G
acgggancatngagtttgggatacaccgtataccttgtgctctnattgcngtgnnnccnaangctctatggacatttgtgtgctaaatcctattaaataaaaaagacgggttaaaacccagatgctgtatattcatttgtaattatgtataaagtgaagcagttttaaactgtaaagatttttttcagtgtgttttctcgaattttgccacaacatactggcttcgtattttatttatctttctttctagttaccagcttcagacccttgtaaagtctccctcagcccttttcaaaaaataataaatttcctgtgang

SEQ ID NO: 34200 - DNA, 188 bp, Homo sapiens
  misc_feature 101, 113, 147, 155, 175, 183: n = A,T,C or G
tagaatcttagttcaactttaaatttgcccacagaaccctctaaatccccttgtaaatttaactgttagtccaaagaggaacagctctttggacactaggnaaaaaccttggngagagagtgaaaaatttaacacccatagtaggcntaaaagcngccaccaattaagaaagcgntcaagctnaacac

SEQ ID NO: 34201 - DNA, 359 bp, Homo sapiens
gactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggtctcctgagaacttc

SEQ ID NO: 34202 - DNA, 274 bp, Homo sapiens
  misc_feature 9: n = A,T,C or G
atcacaagnatctggctgttttaccattgtggaagacagtgtggcagttcctcaaggatctgcaaccagaaataccatttgacccaacaatcccattactgggcttatacccaaaggattataaaacattctactataaagacacatgtacactcatgtttattgcagcactattcacaatagcaaagacttggaaccaacccaaatgcccatcagtgataggccagataaagaaaatgtgccacatatacaccatggagtactatgcagccat

SEQ ID NO: 34203 - DNA, 316 bp, Homo sapiens
  misc_feature 295, 306: n = A,T,C or G
gtgatactttctcttgtaaatctgctttcttttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcattcttcttatgcnttcaaaggtcnaaaaaacatt

SEQ ID NO: 34204 - DNA, 471 bp, Homo sapiens
atccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcacttttttttttgaggcatctgacaaagtcacaaagtctcagactagaaataattacccagtatgatcatggcatccaagaccagagtctcagaactcattaagaaacagtttacttggaatggagaatacccatctgta

SEQ ID NO: 34205 - DNA, 496 bp, Homo sapiens
  misc_feature 2, 17, 495: n = A,T,C or G
tntattggccgggagcnaggctaggtcttttgcaattccataactattttattattttattattgtagtgacagagcgagactccatctcaaaaataaaaataaaaaataaaaaaatcccactcaaggccaggaggggagcaacggagctgttttttttgtctggggaggagctggggtccctcatggaaaatcagatgctggttgtagaattaagatttctcccattgcacggcgaggacccccaggatctggaaatcaggcgtactgcagactgatagatttctggagaacccaaagaagcaaaaatagggccctttatctgcacttccacaagtcactcccacaaaaatacccgccctgcaaatgagctcacaatgcaagttataaacccaaggaagccatagatggtgaagtaggagccagctgacaggtaaacaaaccgtgcttccttggaagaacttaaggagcaaagccgtccaaaggaaactggcanc

SEQ ID NO: 34206 - DNA, 476 bp, Homo sapiens
gggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaat

SEQ ID NO: 34207 - DNA, 453 bp, Homo sapiens
  misc_feature 20, 24, 58: n = A,T,C or G
ggaaaaggtatcagataatnaatnggtctgcctctgctatagccagtgtgctgctgcnttaaaagggaacaaaaggaaggtgcaacgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgtt

SEQ ID NO: 34208 - DNA, 171 bp, Homo sapiens
  misc_feature 13, 16, 28, 54, 67: n = A,T,C or G
tggcccgggaganctnaaaatgtgttantccctctctctgaaacgccttccctntaactcgagtttntaggggaagaaaaagctattgtttacaattatatcaccattaaggcaactgctacaccctgctttgtattctgggctaagattcattaaaaactagctgctctt

SEQ ID NO: 34209 - DNA, 193 bp, Homo sapiens
  misc_feature 3, 18: n = A,T,C or G
tantggccccggggaaantctggttaggcctggtgttagggttctttgtttttggggtttggcagagatgtgtttaagtgctgtggccagaagcggggggaggggggggtttggtggaaattttttgttatgatgtctgtgtggaaagcggttgtgcagacattcaattgttattattatgtcctacaagcac

SEQ ID NO: 34210 - DNA, 103 bp, Homo sapiens
tgaaaaagccaagataaagtctgtctagctctcttagctaaaagaaagtcaattcaggtagaaacaaggctaagtgattaaaagaaaaggaaagtctaagaac

SEQ ID NO: 34211 - DNA, 401 bp, Homo sapiens
gagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggcttgaaggagacgagtattttggccattgccatgtactgctgggtacttttgagaaggtgagtgactttagagggcctcgctttattgcctttagccctttctttcgtgtgagacacatgtaacccgtttgctgggtgcctgagctcagcagaatgggtctggctttagaggctataatggtgaaagaggttgcagtgagctgagatggcaccaccgcactccagcctgggcgatagagtgaggctctgtcgc

SEQ ID NO: 34212 - DNA, 468 bp, Homo sapiens
ggggggctcgggtccagctctctacctccagcaaggcagggttttccctgctggccccacatgggcagcaaagtccaagaccctgattttagatgtagggaatcctgtcgcctgccttccacccagggcttgagcggcttcaggccgcacatcccccattccagtttcactttctccttcagcttggattcctggggatttcccttaattctgtgaaaggctgactgtgccatttgtccagcattctacgtgtctgtggaggaagacacttcaggttatctccttcttcatatcactggaaacacacatgccatgcaaattacacaaaggaaaacagtgcagaggccgcactgtgcttcatctcacatcacattgacaattgcctccaagaaccaactgtgtgttctccctaataaagaaagatagctgggcacagtggcttacacctgtaaccccaacactttggga

SEQ ID NO: 34213 - DNA, 476 bp, Homo sapiens
catggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctg

SEQ ID NO: 34214 - DNA, 488 bp, Homo sapiens
  misc_feature 2: n = A,T,C or G
anggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacaggttatcttat

SEQ ID NO: 34215 - DNA, 316 bp, Homo sapiens
gacatagagaatcatcaaatagacccactagtggggctgtctgccccatgtctgaagtgtagtaagagcaaagtgactctgtccactataggggaggctggactggaatcactcagtccaaagaagaccatccacgggccacaaactgcaatgcctacatggctgggaggtcagcttaatcagggccattgtaaggtcattgtaggtggtagtctttcaccacagatacactgctagcttgttattcttcatctccacaaagccatgtgcttttgaaacctgtagccctgtagttccttttgacaaacacaggtgc

SEQ ID NO: 34216 - DNA, 124 bp, Homo sapiens
  misc_feature 41, 74, 114: n = A,T,C or G
atgatatttttggactagattttttttttttaggcggggtntctcactgcaacctcaaattcctggactcaagngatccttccacctcagctactcaggaggctgaggtagganaatcgcttga

SEQ ID NO: 34217 - DNA, 299 bp, Homo sapiens
  misc_feature 33: n = A,T,C or G
gtaaataattaggaaaactaagcagccccaganataagacctcctggcatcattgtcccttcttatggagtgataatgtaaccttccttgaagtgtatcactccatcaccagtcaagctgccgcagcctatgcactggacttgaatggaaaatgtggtggttctgggaaagcttctctgtatttccttgtgtgtgtgaaatgttaatgtctctacttgggaacgctgaccccattcatttggagttgaggtttccaggtggctattctcatgctttgtgtccaaataaactctataatt

SEQ ID NO: 34218 - DNA, 447 bp, Homo sapiens
cagaagagttgcttcatttcatctgggagcagaaaacagcaggcagctgttaacagataagtttaacatgcatctgcagtattgcatgttagggataagtgcttatttttaagagctgtggagttcttaaatatcaaccatggcactttctcttgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagga

SEQ ID NO: 34219 - DNA, 468 bp, Homo sapiens
  misc_feature 16: n = A,T,C or G
attgaaaatttatttngagcggagtaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggttt

SEQ ID NO: 34220 - DNA, 476 bp, Homo sapiens
  misc_feature 18: n = A,T,C or G
catataagctttcttatnttctgtgttcctggagaagaacatttaatttccttcaagaactttttctttgcattcacaacttggctaaccatttggagaaagagacctcgcttttggcctgtttcagctttcaacatgtcttcctcactaagcttaatcatttctgccttttgatttaaagtcaaagacgtgagcctcttcctttctcctgaacagttagaggccattgtagggtaattcattggcctaatgtcagtactgttgtgtctcagggaatagggaagcccaaagggagggagagggacaggggaacaaccagttggtgtagcagtcagaaagcacaatatttattgtttaaatttaccaacttatatgggtgcagtttatggcaccctaaaacagttgtaacatcaaaggtgatggctgacaaataaccataacatataataagaatggaaaaagtttgaaatatcaca

SEQ ID NO: 34221 - DNA, 472 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgccatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgat

SEQ ID NO: 34222 - DNA, 242 bp, Homo sapiens
ggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttcc

SEQ ID NO: 34223 - DNA, 462 bp, Homo sapiens
ggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcacttgtcctatcaccctatacctagcactgtgacaccaccccttaaatcactttgaacctgggaaataagccccctcaacta

SEQ ID NO: 34224 - DNA, 263 bp, Homo sapiens
  misc_feature 15: n = A,T,C or G
aagggaactgagacnagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcac

SEQ ID NO: 34225 - DNA, 472 bp, Homo sapiens
ggcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgaga

SEQ ID NO: 34226 - DNA, 262 bp, Homo sapiens
cacagtggctcccgcccgtaatcccagcactttgggaggccgaggcaggcagatcatatggtcaggagttcaagaccagcctggccaacatagtgaaaccccatctctacaaaaattagccaggcatagtggcgggtgcctgcagtctcagctacctgggaggctgaggcagaggaatcacttgaacctgggaggtggaggttgcagtgagccaagatcgagccactgcactccagcatgggcgacagactgagactccgtc

SEQ ID NO: 34227 - DNA, 476 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtgatt

SEQ ID NO: 34228 - DNA, 471 bp, Homo sapiens
  misc_feature 434, 443, 470: n = A,T,C or G
ggttgttcagaaaatgcagccctgaagcttttatgtagaaccgatgtctccttcaagctcaaaggcagtttctccttgaccagtttttccttgacataacgtacttaagtgccacagcatttatcagactaagcctggagtaattcgcccagtacctgtaaaatccagaatattactgaaaaaagaggaggaagtctatgaacccaaccctttcagtaaatacttggaagataacagcgacctcttttctgaacagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttccaaaatgagggctccctttatgagctgcngggccccanaaccaaaaaaaaagttggctgcaattnt

SEQ ID NO: 34229 - DNA, 445 bp, Homo sapiens
cttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcagaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 34230 - DNA, 415 bp, Homo sapiens
  misc_feature 12, 29: n = A,T,C or G
gaggagacagcnaacctcaggcttagatnatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtctgtcctaaggct

SEQ ID NO: 34231 - DNA, 462 bp, Homo sapiens
  misc_feature 9, 354: n = A,T,C or G
agaacgagnattccgtctcagaaaaagaatgagatcctgtcatttgcaacaacacgatggaattggagatcattatgttaagtgaaacaaaccaggcacagaaagacaaacatcacatgttctcacttatttgtgggagctaaaaattaaaataatggagctcatcaagatagagaataaaatggtggttaccagaggctgggaagggtagtgggggaaggggaagggaggtgcagatggttaatgcatacaaaaaaatagaaagaatgagtaagacctagtgtttcctagcacaactgggtgactatagtcaaatataatttaactgtacattttaaaacaactaaaagagtntagttggatttcatataacacaaagaataaatgtttgaggagatggacaccccattttccatgatgtggttattccacattgcatgcctgtatcaaaacatctcatac

SEQ ID NO: 34232 - DNA, 472 bp, Homo sapiens
  misc_feature 10: n = A,T,C or G
gaaaaaagantagggaaggcagagtcaattgggaaaacctgagtagttacagtaaattatgttattttgagttctttgacctaatgatctgcgttagtccaaaagcgggctgacttgagaggtaagcttgaattttagaacaatagttttcccccaataactatggaatggctggctatatctcttgttttttatagaattgctatctatagaacttagatgaataagcacaattgaagtgcaaagtgttaaacgcatgcttcaatttagtcaatgcatttgcacattgaagtaattaggattatttaaaagcattctgcttctaatactttgttctccatttcctacaaatcaaattagtgaggggtagatttgattttgacatcattttgaaaatattttctttctttttttaatttccttagtattacatttttacaaagttcaacacacaaccaactgtgactaaatt

SEQ ID NO: 34233 - DNA, 150 bp, Homo sapiens
cgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 34234 - DNA, 130 bp, Homo sapiens
gtttttatgtataaattaaacatttatgactttgaatgctctctgacatcatgaatagttggttggttggttgtttttttgagatggtgtctgcactccagcctgggcaacaagagcaaaactcagtcct

SEQ ID NO: 34235 - DNA, 474 bp, Homo sapiens
  misc_feature 336: n = A,T,C or G
atgataatacttggaatctggttgaagtccaattatacagattttttttaaagtgtaaatttgatggtgtaagaaggagtaaacaataaggtcagatgtttgaatggatgtttgagttaaaggactgagtaaataaatgatggaaaataatcataatttatgttgcttttataagaacaatatacctgaagatgtctctaaagtattttagtattacagaaaacagcaaattattgcatattgtaatgtagcataaatacatagtttttggtcctaatatgattttgtaacagtatgtgatagagatgcatcttaatttagacttcatggtatttngtatgttttagatgttaagctgttgagatattaaatccatatataactataaatctcccattgataaatgaagtgcatgtgtctagcctttaaaaaattccttattaaaagattctcaggtcttataaattttttttg

SEQ ID NO: 34236 - DNA, 187 bp, Homo sapiens
agagtaaaagattagctgccttggcctcccagagtgctggaattacaggtgtgagccatcatgcccgacgagcagcttataagcttaatgagtggaagaaaacataaatatggatgggaatcagttcttcaaaggagcatcatataattaaatgcaaaattcaggacatctagtatttcagataggg

SEQ ID NO: 34237 - DNA, 370 bp, Homo sapiens
gttttcctttgtatttatcttgcttcagttctctgagctccttggatctgtggcttcttgtctttaattttggaaattctcagtgattatctcttcaagtagcttgttaaatatttcttctccctttttctgggactttgatcacatgtgtgtgaaaccattggtattgtcccacacatcttgggtgtttggtttgggggttgctgatttgttgctttgtttttactctctctgtgttatagttggctaatttctattgatcttgcctcaattcacatatttttttgccttgcttttgtctagttggctgataaacctgccaaaggatttctatatctctgatgttaaagattttcttttcttttctttt

SEQ ID NO: 34238 - DNA, 110 bp, Homo sapiens
  misc_feature 33: n = A,T,C or G
catgccctgtaatcccagcactttgggaggccnaggcaggtggatcacgaggtcaggtgattgagaccatcctgggtaacactgtgacattccatctctactaaaaatac

SEQ ID NO: 34239 - DNA, 497 bp, Homo sapiens
  misc_feature 1, 11: n = A,T,C or G
naattcggccntttatggcccggggaggtaggcattgaggcagccagcgcaggggcctctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttggaaggcgatcttttaaaaagagattaaaccga

SEQ ID NO: 34240 - DNA, 187 bp, Homo sapiens
catctcccatgagcagcacatgagagtctccattaattgcatatggcagcgaaaagtgatctcttgcattgtcgtgtattttttatcacgtttaatgtaatatcgtaaaccttaaataacaccatgagacctataggaagtaccacaagtgttgctcccaggaagcagagaaaagtcataacattac

SEQ ID NO: 34241 - DNA, 476 bp, Homo sapiens
  misc_feature 7: n = A,T,C or G
agcaganaaagtaatcttttaaaataatgataccatgccactcactagcttaaaacttttcaattgcttcccaatgcaattagaatataatctgtattccttgtcctggctttgaaacttcctgctcagctctctgtcctcatcttgtaccatggtcctctcatctctgtgctctaaccatgtggctctttctcagacatgccatgtttattcccactgttcccattgtagggctgttcaccctgtcttgaatgctcttcccctgggattattgtatggtcattccttcttatcacgtaagtcccatctgacatgtcatctcttcaaggagggcttccctgacttaccagatgaagtaaacacctcatcatagtagcctgttgcccgatgttggtaatcttcatagtgcttacaacactatagtttattaccatattttgcttaaatttggtaatgcaggttatttatctatttta

SEQ ID NO: 34242 - DNA, 471 bp, Homo sapiens
  misc_feature 58: n = A,T,C or G
gtcacccactgtgggaagttggatgttgcattgcatttgtctctcagtcttaaaagtnaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgaattatgtttagccaacatgtgttggcatctgacactaaataaatacttgtccaatggaaatgaccagaatttagtgcccctaacacttcactgtagtatttgccatatggataagcaatctttattatgctattttggatttaagttccaaagctaaccccacctccttatattg

SEQ ID NO: 34243 - DNA, 159 bp, Homo sapiens
cgtttaaaagttgtaggcgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaa

SEQ ID NO: 34244 - DNA, 197 bp, Homo sapiens
actgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 34245 - DNA, 121 bp, Homo sapiens
  misc_feature 35: n = A,T,C or G
agctgagacccttatttaaaactcacctcccaatnaccccaaacatatggaagggactcccaggaccctgtgcccagcttccatgctgactgatggttaaataatgtgattgtctcctccc

SEQ ID NO: 34246 - DNA, 500 bp, Homo sapiens
  misc_feature 7, 8, 37, 38, 57, 245: n = A,T,C or G
tagcctnntggaccgggaaggaaccggcacttggagnncaaacatctgaaacttggnaagactagtctttggaaattgcctactccatttgagtggaagcgtgacctgatcacccatggcatgcctgtactggcagtttggttttttgtttttgacttgacttggattgcttgatactttggttttggttttgacctggcttggatttcttgatactctgattttggttttgattctggtttggngtaaactgtaaaagtgtgtgtgtgccctttttacccgttctttttgtggtgtgcgtgcagtgtgagcgtggtgttttgtcttgaggaagcatgggtcaggcacaaagtaagcccaccctactaggaactatgttgaaaaatttcaagaaaggatttgagggagattacggtgttactatgacaccaggaaaacttaggactttgtgtgaaatagactggccagcattagaggtgggttggccatcagaaggaagc

SEQ ID NO: 34247 - DNA, 467 bp, Homo sapiens
gaaattaacgaggatctaaataaatggaaagacattccatgtttatcaatcaaaagacttaatattgtttagatatcagtattctccaaattgttttatagattcagggcaatctctgttataatcccaactgacttctttgtggaaattgacaagctgattctgaaattcacatagaagtttgagggacttagaatagtaaaacaaccctgaaaaaagaacaaaataggaagactcacacttctcagtttcaaaactaagcaatggaaatcaagacagtggtactggaataaagatagacatatagatcaatggaatataactgagaataaataatatatctatggtcaactgatttttgacaagggtgccagggccattcaatgagaaaagaatactcttcatcaaatggtgctgcaataactggatacacacatgcaaaaataaataaataataatggaaattg

SEQ ID NO: 34248 - DNA, 473 bp, Homo sapiens
catgagagagtcaatatgtagtggaaagaagcatgtagcaaaaaagacaaccttgatccttaataaaaaagaagttggtttatttccaaaataaatcccctgacaaaaaacctggtgatgttaagcaattgactgtcttagagtccagcagaagaccttagacaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttg

SEQ ID NO: 34249 - DNA, 471 bp, Homo sapiens
  misc_feature 158: n = A,T,C or G
aatgatatgtttatgtaatattttgactaatgtctctccttcactgacctagcagttctagcagggcagtgattttgctgtgttgcatccccagcacctagtctggtatgtggcattcagcatatgtttattgaatgaatggccatgtggttattcangatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaataggtgtggttctggcctaatgtctggaaagccttgcagaggagtggattaggtctttgtgataaacaggcagccttccctgctcctgtgtctttat

SEQ ID NO: 34250 - DNA, 473 bp, Homo sapiens
gaagtagctgattgtttcaagaaaacatttgaagaatgtcagcagaatttaatgaaactccagaaaggacatgtatcactggcagcagaattatcaaaggagaccaatcctgtggtttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaag

SEQ ID NO: 34251 - DNA, 465 bp, Homo sapiens
gggcgcggcctttgtctcacttcagccgagcgcggggttagggcttcattgccttgtgtcctctgctccgggagacttcggtgattctgccactcactccgtcgctctgtgacctgctggcattgaatgatttatagctaagactccaggacacccctgaagccgagaaatgctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcct

SEQ ID NO: 34252 - DNA, 154 bp, Homo sapiens
gtaactgagattagtagttctatatacatttattaaataagttaatatttgtaaaggcctagaatagtacatagcacatagtaaatagtatgtaggtgtttgctgttataaagttcttttaaatatacgtaagccccaaataaaccaattatac

SEQ ID NO: 34253 - DNA, 476 bp, Homo sapiens
atcgtatagttaactaatttaaaagctgaacagctcggtggtttagtatattgacagagttgtacatccatcaccacaatcaattttagaatgttttcattaccctcaaaagaaaccctgcacctcttagccaatgccgtctgctatggtttgaatggttccccaaagttcatgtgttgggaacttgatcctcattcagcagtgttgggaggtgggacctaatttgagatgattagatcctgagggttgagtgaatggattaatgctgctattgcggaaatgggttagttatcacaggagtggattcattataaaaggggaggcccttttctctttcttttgcccatgtgatgccttccaccatattatgtggcagtaagaagaccctcactagacgctggcccctcaatcttggactttccagtctccataattgtcagccaaataaattttcattcattatgaattacccagac

SEQ ID NO: 34254 - DNA, 460 bp, Homo sapiens
agggaaattggggttcagagaagttaaaaatttgcctgtttatatttgaaaaacaagaacagagctgtaccttacaaaaataaattcatggtagtttaaaggctcagatacaattcagactataaaagcattagaaataaatataaaaaatatcttataattgtgggttatagtcctaaggatgacgtgaaaagtggaagtcataagggaaaaaaagatacatttgtttctattaaaaaataaattcccttacaataaaacattacatattcagttaaaaggctgagaaaaaatatttgcactatacatgacaaaagaccaatagaataaatttcctttgaaacaaacaaaaaggacaagctgcctagttgcaaagtaggtaaagaatagaaatcagtgagcaataaaaggagggaagatgtcagcatatgaaaatgtatttattctattagtattttga

SEQ ID NO: 34255 - DNA, 327 bp, Homo sapiens
  misc_feature 2, 21, 30, 32, 38, 40, 41, 44, 52, 57, 59, 60, 68, 70, 73,75, 76, 78, 129, 145, 156, 199, 326: n = A,T,C or G
anagttaaatggataaatagntacaaggtnantgaacngnnctngggctganggctngnngactatcncnaantnntngacgtggggctttaggcattatcaatcggtcaaattcctaggaactgcggntattgctcgccacagnatcttatcagntaattgcactcttagatgtgctaagagtcagcttgcacaagtnaagtccttgaggaaggggctgccagtgaaaaagccaagataaagtctgtctagctctcttagctaaaagaaagtcaattcaggtagaaacaaggctaagtgattaaaagaaaaggaaagtctaaganc

SEQ ID NO: 34256 - DNA, 472 bp, Homo sapiens
cacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgtt

SEQ ID NO: 34257 - DNA, 473 bp, Homo sapiens
  misc_feature 23, 34: n = A,T,C or G
atagaaatgtaagtggaattgcnttaacctgtgnaaaaatgctggtttcttttagctgtagattattgagtcaatatcaaatgctaatatacaagggacaatagtgcattaaatttaataggtagttctgttataattattgtgaaaatttttaatatagtgttgatttgtcagtgttctaattcactgttaatttgcggttttcataatattacctttatgtaatttcctaggcatcgactgtgaaatctgtgttagaattgattcctgaattaaatgaaaaggaagaagcatacaattccctcatgaaaagctatgaaaaatgaaaagcttttttgatgttgagctgatgatcttgatgttgatgtagatttctacataattgacatgtccctctccacaacagttcctggattatcttgatttcacagtggttttaagccaaaggggattgaatgtctcagagaaagatg

SEQ ID NO: 34258 - DNA, 100 bp, Homo sapiens
  misc_feature 36, 63, 65, 97: n = A,T,C or G
aatcggacaaattcctaggaactgcggatattgctngccacagcatcttatcagttaattgcncngtgagatgtgctaagagtcagcttgcacaagntaa

SEQ ID NO: 34259 - DNA, 467 bp, Homo sapiens
gtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagtttggagttctatcttaaggaaaatc

SEQ ID NO: 34260 - DNA, 476 bp, Homo sapiens
  misc_feature 10: n = A,T,C or G
atattgagantaacaagtaaattgtttattaatatttctgatatgtaagtataaaattttgggggcaaagtagaatgttttataaagaaaagtaatttatttttatacaaatttatcttctccatacatgaaaagttcttattttttctttccaaattcttatgtattttgaatgtcactttttttctgacttgaaaatgttatctttattgctctcggtaatgttaatttgctgtgagtttaatgttatgactggtaatacactagtgatcttcaagaacacaaaaggtgctgggcttggtagttcatgtctgaatcccagcaattttggatactgagacagggaggtttgcttgacccaggagttcaagaccagcctgagcaacacaggagtcctcctcacctccccagccacctctacaaataattttaaaaattagccaggcatggtagagcataactgtggtcccagctac

SEQ ID NO: 34261 - DNA, 473 bp, Homo sapiens
atggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttt

SEQ ID NO: 34262 - DNA, 200 bp, Homo sapiens
ggaaatgagtgaactacagctatacctcacaataagaatgaatctcagaaaatattaaggaaaaaagcaagtttgaagagaccacatggggcgtactatttttattgagcccaaaaacaagcaaaaccaaagaatatgtagtctaagcatacgtatacaataaaactatgctattaaaaaaaaaggtaactggatgaacc

SEQ ID NO: 34263 - DNA, 298 bp, Homo sapiens
  misc_feature 38: n = A,T,C or G
gggagcggccaacatggcggaacgcaggagacacaagnaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccat

SEQ ID NO: 34264 - DNA, 466 bp, Homo sapiens
gagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcac

SEQ ID NO: 34265 - DNA, 374 bp, Homo sapiens
ggagcagcacccagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctcc

SEQ ID NO: 34266 - DNA, 325 bp, Homo sapiens
atagaagaatgtccctctaattaggaagcacgtgctaaaatatttaggggtcaagtgtcttcatgtctgtgctttcaaatggttctagataaaatgaacatgtcagaatgctaataattgatgaatataattatggatgtcctggtgattattatacgttttttcaacgttactgtatgtttgaattttttaataataaatttggggtctgggcacagtggcggtaattccagcacttccggagaccaaggtgggaggatcacttgagtccaggagttgagcctggggaatatagtgagaccctgtctctaaaacaaaacaaaac

SEQ ID NO: 34267 - DNA, 364 bp, Homo sapiens
ggactcacaaaatgccaagggggtgactggtagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacct

SEQ ID NO: 34268 - DNA, 360 bp, Homo sapiens
ggacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatg

SEQ ID NO: 34269 - DNA, 173 bp, Homo sapiens
  misc_feature 16: n = A,T,C or G
caattgtttaagaatntggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttgggg

SEQ ID NO: 34270 - DNA, 161 bp, Homo sapiens
  misc_feature 139, 160, 161: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttgcnn

SEQ ID NO: 34271 - DNA, 150 bp, Homo sapiens
  misc_feature 44, 121: n = A,T,C or G
ctgggagatcatttcagtccacaccaaccatattattcagggtncctgccatatgtgtggggtatcctactgatacacacgtattcaaagttgatgggtacaacaaagacatagtacatgnacataatatgtatgtgaatatagttaaat

SEQ ID NO: 34272 - DNA, 141 bp, Homo sapiens
  misc_feature 24, 26, 44, 100, 132: n = A,T,C or G
tagtagagacggggtttcaccgcncnagccaggccgggctcggnggctcatgcctgtaatccctgcactttgggaggccgaggcaggcggatcacaaggncaggagatcgagaccatcctggctaacacggngaaaccctg

SEQ ID NO: 34273 - DNA, 226 bp, Homo sapiens
  misc_feature 22, 65, 69, 70, 74, 142, 159, 164, 196: n = A,T,C or G
aggactcgagcaagcttatgcntgcggccgagattcgagctcacttggccaattcgccctatagngagnngtanatggccatgggtgaccagcttcacagcccccctccccttcgtggaggttaggaggtagggctcagatntccagccctctaatctngcctngggctttctggtgaccagcccccatcctgaanctgcctaggggctgcctaccattgatgata

SEQ ID NO: 34274 - DNA, 254 bp, Homo sapiens
  misc_feature 5, 246, 253: n = A,T,C or G
ggttncgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcntgaaaanc

SEQ ID NO: 34275 - DNA, 284 bp, Homo sapiens
gcttctacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 34276 - DNA, 408 bp, Homo sapiens
  misc_feature 7: n = A,T,C or G
aagggtntcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcagatatgattatggaacttgctgtacatgctcagtttattacaactacttttaggcctgaactgcttgagtcagctgacaaattctatggtgtaaagttcagaaataaggttagtcgtattgatgtgatcacagcagagatggccaaagactttgtagaagatgataccacacatggttaattggaaaatactacctactggtttgggagatgtatatagtaatatga

SEQ ID NO: 34277 - DNA, 416 bp, Homo sapiens
  misc_feature 6, 7, 33: n = A,T,C or G
ggcagnntgaatcgcggtgcgacgaaggagttngtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaactttgctattcgtggagatgaagaattggattctctcatcaaggct

SEQ ID NO: 34278 - DNA, 488 bp, Homo sapiens
  misc_feature 8, 33: n = A,T,C or G
gaagggcnttttatacatacatatgtacatatntacatacatgaatcccatatgtgtatgtatttttaaaattggagtggctaaatccatactagaaggtacctaattaagagttctaaaaaaaagtgatttagtgatactatagataaaaatatgtaactttattacaaagtgtataaaaagtaattttttatacactttgtaatacacaaagtaattcacacctttttatacacaaagtaattcacaatgtgtataatccaggtgattaatgaattgctaatgtgactggtatccagagtggttcaagagagaagaccatggaaagaagggtgtaaatgaatatttaacagatgattacaggatattaaggcaaattagaaatgcttgggggtaccactttaattatcaggtggtagggcagccacaggtttttatataaggtctcctctcattgacaaattactgagccataccaacctgcaggt

SEQ ID NO: 34279 - DNA, 107 bp, Homo sapiens
attgtcccaaatggtcacccttttttgatgaaactaaatatggcttgacattattaaggactgatagaaattcataagtgacccagactaccaagcaaactaatcga

SEQ ID NO: 34280 - DNA, 140 bp, Homo sapiens
  misc_feature 127: n = A,T,C or G
acttttgtgtgattgtcattactaattgaagggcaaccaggttgtaaaattcagcgtatttattttcttaacagtattcatctttaggactgtcgtttgaggatagcataggaatatttggtttgcnttactgagaaact

SEQ ID NO: 34281 - DNA, 316 bp, Homo sapiens
  misc_feature 6, 25: n = A,T,C or G
atggcngaacgcaggagacacaagnaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagac

SEQ ID NO: 34282 - DNA, 352 bp, Homo sapiens
ggaattcggataaaaataaggaccctacctagtatactggctaaaaagctatatgatatctggagatactgacaattcttaagaatcgactttacactagtcatgataaatcacatccttgtgatttccagatgaagctagaaagcaatgttcaagaggctatcagaatacctggtaatttcatggaatactacacagccataaaaaagaatgagattttatcctttgcagcaacatggatgaagatggaggccattattctaagaaaactaaactaattcaggaacagaaaatgaaacactacatattctcacttgtaagtgggagctaaacattgaattcacatggacac

SEQ ID NO: 34283 - DNA, 431 bp, Homo sapiens
  misc_feature 15, 16: n = A,T,C or G
agcggactcctttgnntttggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggggttgggtgagaacctgact

SEQ ID NO: 34284 - DNA, 463 bp, Homo sapiens
tatggccgggcaggcccggtatcctgtgagcatggccattattccccaagacagaggcatatactaggttggtgcaaaagtaattatggttttgccattaagagtaataaatgggaagcttctgatttgggccttggttgcaccccagctttgccacttactagcagtgagacttgggtgattactcagattcttctgaggctctgttttttggctgtcaaaatggcaagcaacatctcagagggtccttgcggagattacatgaactcctggctcatgctactaataatctgtggatttctctagaaaaatattgttttctttcctatgggaagccaccaccgtcaaactttattttgagttgtattgttttaaaactatttaagaagggcaataaatatttggtctatttaaagagcaggctaggctgggtgcggtggctcacgcctgtaattccagcact

SEQ ID NO: 34285 - DNA, 276 bp, Homo sapiens
  misc_feature 260, 265, 271: n = A,T,C or G
gggacgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagataggaaacaagataggaaaatggaaaatntttgnccaagnagttt

SEQ ID NO: 34286 - DNA, 214 bp, Homo sapiens
  misc_feature 6, 32: n = A,T,C or G
actganaaatgagggcagagttctaagccctnctctaattctaaaattctaattaaaacgtcgcgagactagtggtgcatgcctgtaatcccagctactcgggaggctgaggcgggagaatcgcttgagcctgggaagtggaggttgccgtgagccgagatcgtgtcattgcactccagcctggcaacaagagggaaactccgtctcaaaagag

SEQ ID NO: 34287 - DNA, 188 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaaaattttaagagaaaatatgaagacttagaagagtcac

SEQ ID NO: 34288 - DNA, 263 bp, Homo sapiens
  misc_feature 6: n = A,T,C or G
cagtgncttataaacctagcttcgtgacaccccaggacagtggttttcaaagtgtgaactctgaaccagtagcatcagcatcacccaagaactctgtacaacttttcaggccctaccccagacttgctgaatcaggcagtctggagagctgactagccctccgggtgattctgatgcaccataaagtttgagaaccacagtcctagggcacttcaaattattttcatattgtgcatttttaaatgttcaatttctttttaatt

SEQ ID NO: 34289 - DNA, 423 bp, Homo sapiens
gttactcggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgta

SEQ ID NO: 34290 - DNA, 445 bp, Homo sapiens
  misc_feature 8: n = A,T,C or G
ataactcngtttttatgactttaaatttgaggacatttgattgatgtcctcaaagcattaatggaaaaagttttaaattaaatattaaaggttcttctttaaagaaaatatttgttattaaacaaaaccaaaagaatgaaggagtgtaattgttttatcaggcgatgaatggtgctatccttcaacaagtgtttgtggtggattatgttgttcagtcccaaatgtgtggagattgccatagagtagaagctaaggatttctggaaggctgtgattcaagtgaggcaaaaggtaatgagagaagatgatgagtgagtcctacatcttatatttcgtctttgttaattataacttttccttctttctaaatccagggatagtctgggtccctgaagcattcacctttggaaatagatcattattacattttagataatctttaaaga

SEQ ID NO: 34291 - DNA, 389 bp, Homo sapiens
  misc_feature 2: n = A,T,C or G
cngggtcaaatgcagagtttatctagtgtcttctcttctgccatcagagcttcccaatcctttcatgttgtcatttgaagaggtgaatcctagcctaaccattaactgtttgtgacattttaatgggtaaatgtaaatatttctgtagtaaagacgtgttaggtacctaccctgtgtaatgaactgtatcgaattcctccttgtgaagggggatgtaaagaaatttgagtaagttttttactagcctgggttctaatataggtaatatataactaacagactgtaataacaactggtttgatagcacagaggaaattattaatgttaactgggtgaggtgagaaatagggagaagatcacatttaaacttgcccttaaagtattaatag

SEQ ID NO: 34292 - DNA, 489 bp, Homo sapiens
  misc_feature 1, 3: n = A,T,C or G
ngnttccctatgctttgtctctgtgtcttatttcttttctcagtctctcatcccacctgatgagatatcccacaggtgtggaggggcaggccaccccttcagtgttcgctactttcagtgcttacaatgcctgtcatttatctgtagctcttatactttttataaaaaataattttataccaaaagccttgaaacttttttagagtagtagctttgaattgttgttattattttattctactgttatcggtaacctcccatgttaacactattgtttctttctgtttactttcagttggttggcagagaatttgaactggagatgaactttattatccaggatgctgagagtataacatgcatgacagagcttttagagcactgtgatgtaacatgtcaagcagaaatagggagcatgtctacagccattctatgaaaaagtgttcggaatgtacagactagcacagaagctggactaattgaacaagt

SEQ ID NO: 34293 - DNA, 189 bp, Homo sapiens
  misc_feature 6, 32, 33: n = A,T,C or G
gtaggnccgtgtgagtatggggcgatggtgcnnggaaccttgctttaacatgctattttgaaagatatccccttttattttgtagaaatgggttaccacgttgagcaccaggagtttcttgtacatttggatcctagcagaggaaatgggactttagaaagattactctgaactctgaagggctaattt

SEQ ID NO: 34294 - DNA, 210 bp, Homo sapiens
  misc_feature 31: n = A,T,C or G
gagggctgtgaaccaaggcactactgccacntgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaacc

SEQ ID NO: 34295 - DNA, 255 bp, Homo sapiens
  misc_feature 5, 31: n = A,T,C or G
cactnccctgaaggaaggatgcaggcctgtnctggcttgctttgccaccttctgattaaagagctgcagggcctggagtgaacagaggcagtaaccaaggagtggttacatcaggccttgggtgagacctagtgctatactggattcaggtctgacccagcacagtcatagtggtggtggccacaggggtgcttgtgtcactctacccccacctataagtggcttggagtgcaggaagagactctgtgtgggaga

SEQ ID NO: 34296 - DNA, 249 bp, Homo sapiens
  misc_feature 24, 25, 27: n = A,T,C or G
aaaaactatataattttgtgtggnntntataggtaaatatatttttgactttggggtagtgaaagactccttaagccacaaaaagaatttaaaaagaaatgatgaacatacttgaccatatgaaaattagaacctaaatccataaaccttaagaaagtgaaatctaaactacaaactgggagaagagataaatagtctcaagactacatgaagaactctgataaatcaatgagaaaacaacctattggg

SEQ ID NO: 34297 - DNA, 119 bp, Homo sapiens
agtcacagttgtgagcaagttcggtgccgcgggctgggattagaattacttgttattggtaaatagccactatggagactaaggaccagaagaaacaaagaaagaaaaatagtggaccc

SEQ ID NO: 34298 - DNA, 263 bp, Homo sapiens
aggacccgcctgggcaacacggtgagaccctgtctctccaaaaagattttttaaattggctgggcacagtgcctctcatctagtctcagctactcgggaggctgaggtgggaagattgcttgagcccaggggtttgaggttacagtcagctaggattgtgccactgtactccagcctgggtgacagagtaagaccccatctctaaataaatgttttttattaaagaatatggaatactaagaaataattaaataattcaaaag

SEQ ID NO: 34299 - DNA, 457 bp, Homo sapiens
  misc_feature 7, 32: n = A,T,C or G
agagagngtcaggccgaaccccagttctcctnctcttaggtcattttcagcaaacttgaatatctagacctctcttccaatgaaaccctccagtctattatagtcacatagataatggtgccacgtgttttctgatttggtgagctcagacttggcgcttccctctccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttac

SEQ ID NO: 34300 - DNA, 395 bp, Homo sapiens
gagtcctaagttcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggtggaagcaaatactgcacatgcgtgttggtcctgtgagggaaaccagctagtggagagggagaggttgaaggaacagaaaaatgagaagacaactcactggaggctgaagtgggaggatcgcttgagtctggaagcttgagactgcagcaagctgtgatcgtgacactgcactccagcctgggcaacaaagtaagatcctgtctcaaaaga

SEQ ID NO: 34301 - DNA, 421 bp, Homo sapiens
agctgccccaaagcagcatgttgagcattgcttggtctttcttaagtatgggaggttctatcaatctagtaaaaccttggccttttaggcttggtaactaaacaggggaaaatttgtttaattgggagtaaattctgaatattaattcacattaaccaaacaatagagactaacgtatgaagtcagaatgtcaattcgttaatttttgtgagaaacaaatctgccaatgggaccctatgttgtacttttatcttctggccaacatattccaccccgtaggtacactatatggaagccgagttacagtcactggttccttagtattatagacagcctctcatttatatgtttataaggaatataaactttttaggtatggttacgggtaacttaatatctgctccctaacctcaaaacacac

SEQ ID NO: 34302 - DNA, 255 bp, Homo sapiens
  misc_feature 6, 32: n = A,T,C or G
gggcancagggaaggagtgatcaggatcacgnctgactcctgcagagacatctgtcatgtgtagaaggaaggtggcagacgcgaaactctcctaagagaaaaagggactttctcccctaaaataggctgaacagtggccctggccaggtttgagagacaattctggtggctaattaaaatttcacttccttcataaacccttcgtgccaactaggctaaggcataatccaggctccacttcccacccctccccgc

SEQ ID NO: 34303 - DNA, 210 bp, Homo sapiens
  misc_feature 33: n = A,T,C or G
agccccattaggtctccacccctgactcccctnagccatagaaggccccaccccagtctcagccctactccactcaagcactatagttgtagcaggaatcttcttactcatccgcttccaccccctagcagaaaatagcccactaatccaaactctaacactatgcttaggcgctatcaccactctgttcgcagcagtctgcgcccttac

SEQ ID NO: 34304 - DNA, 317 bp, Homo sapiens
  misc_feature 2, 7, 31, 32: n = A,T,C or G
gngtatnaagaggtggttttttaaaacttcnngttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttat

SEQ ID NO: 34305 - DNA, 466 bp, Homo sapiens
  misc_feature 30, 370: n = A,T,C or G
aatgcccaaaatcggaaaacaacataaaancaaaatgagaacatcaagaaagtgaagccgtgagaaagaaccaaacaaattctagaggtgaagaatacactgaagaaactagaaaatgcagtagagagcttcggcaacagactcagtgaagcagaagaaagaatcaagagaacttgaaaacaggtcatttggaattacccagtaagaggagagaaaagaatgaaaaaaatgaaggaagcctctgggatttatgggacactgtcattgaatgaatatatgcattatagggattgaagagaagcaggcagaaagccttttttttttaaagaaataacccaaaacttcctaaatatggagaacaaaacagatntccagactcaagctcatagaaccccacaacagttaaagaagtctacatcaagacttattataattaaattgtcaaaactcaagagacagaattttg

SEQ ID NO: 34306 - DNA, 282 bp, Homo sapiens
ggactccccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacac

SEQ ID NO: 34307 - DNA, 342 bp, Homo sapiens
  misc_feature 32: n = A,T,C or G
tatgcaacaaacctgcaatttctgcacatgtntcgtggaacttaaaataactattacagggccggtcactgtggctcatgcctgtaatcccagcacgttgggaggccgaggcgagaggatcacctgaggtcaggagtttgagaccagcctggccaacatggtgaaaccccatctctaccaaaaatataaaacaattagctgggcatggtggcagacgcctgtaatcctagctactcagaggctgaggcaggagaattgcttgaacctagaagatggaggttgcagtgagccgacacggtgccacctgcactccagcctgggtgacagagtgagactctgtct

SEQ ID NO: 34308 - DNA, 470 bp, Homo sapiens
  misc_feature 2, 12, 29, 209, 210: n = A,T,C or G
tnccgtcttatnagttaagtttagctaanttgaatgtaatgtcaggtgccaagatgatgatgtaagtaaacaacagaccacatatacaacagtggtcctgtaagactttagtatcatatttttactctacctagatatgtttatatacacaaatacttaccattgtgttacaactgcatatagtatttagtagtagagtaacatgctgnntaggtttgtagcctaggagcaataagctataagcttagcacactcttatgttagcacaaggaaaagaaaatcgcctaatgatgtctttctcagagcacatctttgtcattcagtgatgcatgactgtatatcataagttctcaaagaaataaaacttaaatataaaccttggtcttcaaaacatttaacagtatttaaaaagagagagattttacccttattagttgtatttgttaaagtcccagtaacttggttggtat

SEQ ID NO: 34309 - DNA, 404 bp, Homo sapiens
  misc_feature 9: n = A,T,C or G
cacagaacnaaactctgcattctcgcttcctggtagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggaatttggtctctttgactaatcaccaaaaagcaaccaacttagccagttttatttgcaaaacaaggaaataaaggcttacttct

SEQ ID NO: 34310 - DNA, 287 bp, Homo sapiens
aaataaccacatcgctaaataattgatatttgatgaaaatctgctttgtataatttctgtaaattatccttgttctgaaaaaggtgtaatgccctaatatttttaaatccttatccttttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaatt

SEQ ID NO: 34311 - DNA, 105 bp, Homo sapiens
  misc_feature 12, 96: n = A,T,C or G
acaacacacagngatcttgttctaagagcaacaaagctgggaattccttatagagttattcacaatgcctccataatgaatgctgtaggctgctgnggtttacag

SEQ ID NO: 34312 - DNA, 116 bp, Homo sapiens
agctactcgggaggctgaagcaggagaatctcttgaacctgggaggcagaggttgcggtgagccgagatcacgccattgcactccagcctaggcaacaagagtgaaactccgtctc

SEQ ID NO: 34313 - DNA, 399 bp, Homo sapiens
  misc_feature 5, 18, 30, 38, 50, 54, 56, 57, 67, 75, 98, 99, 119, 121: n = A,T,C or G
tatanaaaaaaaaaaaanatctccgtgggngccttctncaaatgggagancatncnnggaccctgcntttttttnttgggggagggcgtggctctganntctgtcacggccttctttangngggtgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaa

SEQ ID NO: 34314 - DNA, 498 bp, Homo sapiens
  misc_feature 6, 11, 26, 28, 34, 47, 50, 52, 53, 54, 67, 68, 87, 94, 115,117, 118, 159: n = A,T,C or G
ggaagngacanctttgggggtttgcngntggctntgactcccgaccngcnannngtaagcagacggnngaacaatccccaagaaggnatgaacnggagaaaggggccagaagaangnngagaaggtcgacaaaagatgctgaattagtggcccaatggnactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgag

SEQ ID NO: 34315 - DNA, 415 bp, Homo sapiens
  misc_feature 6, 31: n = A,T,C or G
attctncccggtgcagtggctcacccatgtnttcccagcactttgggaggccgaggcgggcagatcacctgaggtcgggagccaccgtgcccagcctattcttaactttcaattgcagaaggctctctactcacaaggtccagcaattacatctgagtgctcattaataaaaatgatttcttgctatgtcacaatgaaagcactgtgaaattaatagccaagttttaagacatgaaatttctttttttttgagacagggtctcactctgtcccccaggctggagtgcagtggcgcactctccgctcactgcagcctctgcctcccaggagaattgcttgaacccaggaggtggaggttgcagtgagccaagatcttgccattgcactccagcctgggcaacgagcgaaactcttg

SEQ ID NO: 34316 - DNA, 437 bp, Homo sapiens
  misc_feature 32: n = A,T,C or G
ggaaacgatgtcagaaactttaaatttttaanaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatac

SEQ ID NO: 34317 - DNA, 496 bp, Homo sapiens
  misc_feature 23, 24, 49, 200: n = A,T,C or G
aattcccacaataaccctatganntcaatactattttatctctcttggncttgaaaaccactgtttaatgtattttgtctgttttgttgttgttggtgcaaagaggttaattctattctctcgtattccatctcggctggaagcagaagtttataaacattgcattttaaatttattttaaatttagatttttttaattnccattttttgaatactaaatttgactatttcctatatgtttacatttgcatttcttttgtactttgttcctgtatattgtttgctctgtcttctgaagatttaagggtttccttttcagttttatgcatggtcccataagtaaaagcaatatggcttctgtaagagagcatcttacagcaggagaattctggagatctgcaaaggttctccctcaagtattcagcagagcacagattagtacatacgtgtgaggaaactacttgagccagggaaagagtcctctaaaggattattg

SEQ ID NO: 34318 - DNA, 210 bp, Homo sapiens
ttccagaatttatgagaaaaacctcactgtaggttctagagtttgaactgcattttatttttaaattctccaagaaaaaatactgcatcagccttttaaagccctggagattgctatggtctcttgtaatttagctcagtgatttgtttctgctgaaaaacagcagtgaactctagaacatagaaggcttatttgacgtgttgcttcttt

SEQ ID NO: 34319 - DNA, 119 bp, Homo sapiens
  misc_feature 6: n = A,T,C or G
catgtncttttgaaacaaatgcaaatgaaacggctacctcccatctataaagacagcaaactctgtgaagtgatactgctttgctgtctacaaattgcttttctttttcttttttctga

SEQ ID NO: 34320 - DNA, 397 bp, Homo sapiens
  misc_feature 7: n = A,T,C or G
gcacggnccgcggtggcgcgtgcctgtagtcttttcttcccgagtacctgggactgcaggtgcctgccacgacgcttggctaatttttgtgtttttagtagagacagggtttcaccatattggccaggatggtctcgaactcctgacctcaactgatctgcccacctaggcctctcaaagtgctgggattacaggcgtgagcccctgtgcccggccaggatttctactccggaggaagctgaggttcggtgcctgagcagtttaccggggaacgcagagtgctctatagcagagctagcatgggcttttgactactctgcctaatctcatcccacctgaaattcggttttcttccaaattaaatttgtggtagaaacatcctatacattagaagaga

SEQ ID NO: 34321 - DNA, 203 bp, Homo sapiens
  misc_feature 2, 32: n = A,T,C or G
gnacgccgcaatgcagctcaaaacgcttagcntagcccacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 34322 - DNA, 214 bp, Homo sapiens
  misc_feature 18, 33: n = A,T,C or G
ggaaaccaccaccctagnaggtcagagaacatnagaatgcgtctggaacgcctttgaggcgagtctggtttggggggttcttagggcacagaggatccgctggatggaagtaagtcccgggtttctgccagagatgtggaatggtagattttccccctgtccgtttccaagactagctcacaattatgaccgaggtcatgtgtattttgaacat

SEQ ID NO: 34323 - DNA, 500 bp, Homo sapiens
taagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttc

SEQ ID NO: 34324 - DNA, 135 bp, Homo sapiens
ctgaatcttgatatcagaaaacattttcttagtttcttaaaaaataccctcaataaataatactcttaactaataataaaaacactcttaataaataaaacatataaagttttatttgtgacaaactcacaagcg

SEQ ID NO: 34325 - DNA, 479 bp, Homo sapiens
agtaacctgttgtttttataattaataccttgttaataagcatgtaaggtgactactagcattttgcaaatgcgtatagtttataggttagaagcaactgccagttttgtcacatgtgccatagggcggatcctcaccaagttggaaatagtgagctcttgacttgatgatggagtattctttgtgacttccccataagctctcttaaatgattaatgttaggacatacgtgatatttccgtggccgaggcatcaccacattacttcatgtgtgttagatgatcattgtacacgtagcttagtacacagatgcctttagaagacttacaaagaatcgagtgttttctttcatgacatcagtgtttttaatgcttcacactcaattctttacaagctgattaaagaattactttgtgccgtcaatatatattcctttgtttccttcatacaatacagttctgtgagaaaagactgtacga

SEQ ID NO: 34326 - DNA, 257 bp, Homo sapiens
  misc_feature 31: n = A,T,C or G
caatacatgttatactagacagtctgattcntaagcccaatgcctgctttcaccactgctgtttacattgtactgggagttctagtgagaactattagacaacaaaaagaagtaaagggcatcaaattggaaaggagtaggtaacactatctctatttgcagattacatgatcatatgtataaagcatcccaaagaaaccacaggaaagcaactagagctaataaatgaatttagcaaagttacagactataagacc

SEQ ID NO: 34327 - DNA, 155 bp, Homo sapiens
  misc_feature 155: n = A,T,C or G
agtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtn

SEQ ID NO: 34328 - DNA, 397 bp, Homo sapiens
  misc_feature 7: n = A,T,C or G
atagacnttctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatg

SEQ ID NO: 34329 - DNA, 413 bp, Homo sapiens
  misc_feature 2, 6, 30: n = A,T,C or G
gnagcnctggttgtctgaagactcaggagnttttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagat

SEQ ID NO: 34330 - DNA, 171 bp, Homo sapiens
  misc_feature 2, 33: n = A,T,C or G
gnaatccgacattttatagaacactccatcctnaacagcagaaagtaaattctgcacagtgtaaaagaacctttggcatgagccaccacgctcggcctcgacaagctcagtttcaagtggatgtggcatcggaattcacactgcctatattgcttccctctctgacgccga

SEQ ID NO: 34331 - DNA, 166 bp, Homo sapiens
  misc_feature 6, 37: n = A,T,C or G
ataccnaaagttctattggacagtgctcttctagatntcataagactacagagcacttttcaaagctcatgcatgttcatcatgttagtgtcgtattttgagctggggttttgagactccccttagagatagagaaacagacccaagaaatgtgctcaattgcaat

SEQ ID NO: 34332 - DNA, 173 bp, Homo sapiens
aatatttttggaaggaaaactgaaaggtaatgaaaatgttactgttggattaaaaaacaaattaagtccaaatagtgattaggcaagttggtgaggtagggggttgctgcaagagcggaagttgaaagatcttggaaaaattaaagaaacttcatagaaccccatctctacac

SEQ ID NO: 34333 - DNA, 382 bp, Homo sapiens
  misc_feature 6, 7, 31, 32: n = A,T,C or G
ggttcnnaggtctgttaatattctgaaggtnncttctgaaacataaaatctctgtaatctattaacataatttgtgctgttcaaacaaatttaagccaatcattgagagaggtaaactctattttagcatctgctgcagaatgtcttttctcaaaatatttacacttccaatgttatttctgtacattactgctcaaaccagatattcaaaacaaaacagattcttaacaaacaggttttgcccaagtcttacaactctgcaataatatgtgtaatagaaaaatagacagtaattgaaaagtttatgtttttcttgtcttccagccactaaagtacctctgttcaaaatcactatacgggtttagctaattacaatctatac

SEQ ID NO: 34334 - DNA, 192 bp, Homo sapiens
  misc_feature 5, 6, 29, 31, 192: n = A,T,C or G
atatnntaagggtgtactatggggattangntgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcgn

SEQ ID NO: 34335 - DNA, 114 bp, Homo sapiens
  misc_feature 63, 104: n = A,T,C or G
caaactttctgatcttttaaaatattacttaagagaatctcaagctgctaaggatctcctgtntcgaaggtctaggtcactagtggattatgaaaatgctaatnaagcactggg

SEQ ID NO: 34336 - DNA, 398 bp, Homo sapiens
  misc_feature 25: n = A,T,C or G
atggaaatatcgccaagacgaaagnacatgccttgaccctatgtactaagagtgtgctctgtaacaatcatatatttagatttagaaagatttgacccaacactcttgtcctaggaggatatcaaatatcactggtgttggaggtggcttagctaggacatcttaacatattctcctacacactagactcccatgagtagggctatgtgtttgggtgaggaggtgtgcacatgaccacaagtgcccccatgttgtgctttaattcaactatgcttatatttcggattgatttactccccttaggagattctaattgataacaatggaatgttaatgtgacttaaaaataatttccacttgtatctatttgaagttctctttctctcccctcgttttga

SEQ ID NO: 34337 - DNA, 346 bp, Homo sapiens
  misc_feature 6, 137: n = A,T,C or G
agcccnaatagtaaatacttgatgttactttattcccaggtttaatgaaagaacccaacttagtttttcagtgaatttgacacctattttttagtgatgaaatttttctttgagaactggcaaggatgcagtcagcntgtttgcaagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaacttt

SEQ ID NO: 34338 - DNA, 371 bp, Homo sapiens
  misc_feature 1, 33: n = A,T,C or G
nacctgcctcaatttttacaacttttttcctgnaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgccaagctttttaggcttgtcacaaatgattgctttgttttcctaagtcatcaaaatgtatataaattatctagattggataacagtcttgcatgtttatcatgttacaattta

SEQ ID NO: 34339 - DNA, 429 bp, Homo sapiens
agagaccagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacttttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattg

SEQ ID NO: 34340 - DNA, 392 bp, Homo sapiens
  misc_feature 4, 5, 31: n = A,T,C or G
gaannaggaaatgtgtaagttcgtctaaaanctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttact

SEQ ID NO: 34341 - DNA, 189 bp, Homo sapiens
  misc_feature 179, 182, 183: n = A,T,C or G
aagaactgtctgccaggtcattcttcctctttttttttaattgggtaggacacccaatataaaacagtcaatatttgacaatgtggaattaccaaattaaaagagaatactatgaatgtattcatattttttctatattgaataaacaatgtaacatagataacaatataaataaaagnggnntgaccc

SEQ ID NO: 34342 - DNA, 358 bp, Homo sapiens
  misc_feature 1, 5, 42, 44, 47, 66: n = A,T,C or G
naagngccataattaaattcataacaacatttattttagcgncnaanaaaagcaaaatactgcagnaaataaatttgacaaaaattgtataagatctctacattaaaaattatgaaatacatgtaagagaaattaaagaaaacctaaatagagagatataccacattcatggattggaagattcaagattattaaaatactattctccccaaatggctctatagattcaacataatcccaatcaaaatcccagtaggctttggtagaaattgagatgttggttctaaaatgaaataaaatgcagaggacctagaatatataatttccctttaatttgacaaagaagaaaaacatgttg

SEQ ID NO: 34343 - DNA, 234 bp, Homo sapiens
gcgggccgatcacctgaggccaggagtttgagaccagcctgaccaacacggagaaaccccatctttactaaaaatacaaaattagctgggcatggtgatgcatgcctgtaatcccagctactcaggaggctgaggcaggagaatcgcttgaacctgggaggtggaggttgcagtgagccaagattgcgccattgcactccacacttcagcctgggcaacaagagcaaaactcca

SEQ ID NO: 34344 - DNA, 243 bp, Homo sapiens
  misc_feature 2, 20: n = A,T,C or G
tnttggttacatcacatgtnttactatctgatgattatgttggtcatcaatccttcttctgcaaggaacacaatataacaacattacaatgcatctttgttttgtttttgctgatttgggtagaacatagcaaaaataaaaatgcgttcattttctgtcattttggtaataaatctgaagccatgcttaacagaatagttttaagtttaaaatgaaataattttataaatattttaccctttt

SEQ ID NO: 34345 - DNA, 371 bp, Homo sapiens
  misc_feature 5, 32: n = A,T,C or G
ggccnccgcttcgccgctcttccagcggctcngttgccagaagctagcctgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgcttttt

SEQ ID NO: 34346 - DNA, 451 bp, Homo sapiens
  misc_feature 5, 12: n = A,T,C or G
ctaancccattnatctttaaatccttgagcatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattg

SEQ ID NO: 34347 - DNA, 420 bp, Homo sapiens
aaacagcaagccttggcaaagaaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattacccttttttttattttgaatgggaagttctcactaaaacaatcctgagatttcttaatttcatggttctttaaatattataaacacagagtcaacatagaatgaaattg

SEQ ID NO: 34348 - DNA, 423 bp, Homo sapiens
  misc_feature 2, 3: n = A,T,C or G
cnnttctacaaatatgtaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaataaataaaagtgataagaatgtgacatgttaatagggagagatattagtccgatggtaattaaaagcagagaaagttttaaataaactaaatggtgaaga

SEQ ID NO: 34349 - DNA, 355 bp, Homo sapiens
  misc_feature 5: n = A,T,C or G
ccggngttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcact

SEQ ID NO: 34350 - DNA, 468 bp, Homo sapiens
  misc_feature 7: n = A,T,C or G
aaactancgtgtgacctgaacttggtcctagttgcttggtctctgaaacttaagagtacttggttgtactgtatttggttgtcaaggtaagttactagattaggactttgagacagtgtatttattgggaagcacgatgcttgtttaggtggctagacttcttatatttgtttttaggctaactgattttggaagaatctttctaaaatgtaaccctggtcatgtaagcaccttgcttaaaagtattccttagtgtccaggaggtgtttactttctcttcttgtaaaatattctttactgtttttttctcaatctgcctttctagctataattcacctcattcaagactcatcatgaagaactacttgaagttttccaaacatgctattcatatggtcttctgtacaaatttccttgctttacttgtctagactgcttcttatctttcagtattgagctgcaacatga

SEQ ID NO: 34351 - DNA, 283 bp, Homo sapiens
  misc_feature 7, 12: n = A,T,C or G
gggggtnaaacnctgagctaacgtactactgctgctttttggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagc

SEQ ID NO: 34352 - DNA, 350 bp, Homo sapiens
  misc_feature 59: n = A,T,C or G
aattgcctgggggatgaaggcaaaaggtgggataaagaattaatatgctgtttatttcnttaataatagcagagaactaaagaatatcatttaaagctgagaaatatatagaaatgtaaacacatttaattgtacaaagataaacatttaaaaagataatactagttatgaaaattgaatggtagaggaaagggagggcaaggagggggaagaggaaataattttaatattgttctttttaggggattaagagctacagtctaaagaaccagacaattaagggcatacaataataaaggtaataattaggacccaaatcaaaatttcctaaatattataagaaatataca

SEQ ID NO: 34353 - DNA, 312 bp, Homo sapiens
  misc_feature 14, 216, 217: n = A,T,C or G
tcccaccaccgagnactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcannagcgggagtgcgggggagggaaagaaaacaaacagtttcagaattgaataggcaagtgactgttttaaagattaagtaataaagatgtcttatcc

SEQ ID NO: 34354 - DNA, 374 bp, Homo sapiens
  misc_feature 3, 7, 40, 110: n = A,T,C or G
cgnggtngtatcattttgtgggagtctaagtctctttgtnggtctctaagaacagtgcaatcaaattagaactcaggattaagaaacttactcaaaactgcacaactgcntggaaactgaacaacctgctcctgaatgactactgggtaaataacaaaattaaggcagaaataaataaattctttgaaaccaatgagaacaaagacacaatgtaccagaatctctgggacagaactaaagcagtgtttagagggaaatttatagcactaaatgcccgcaggagaaagccggaaaaatctaaaatcgacaccctaacatcacgattaaaagaactagagaagaagagcaaacaaattcaaaagcaagcggaagac

SEQ ID NO: 34355 - DNA, 475 bp, Homo sapiens
  misc_feature 4: n = A,T,C or G
caantgcccagacattttctcttagttgtcctttgccccaccctgtgacaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatgggtgagtaagcagaactttttctgttctgtgaagtgtctgttgagctcagcaaatgtttaaactgaagcacattttactgtagaagcaaattacatacacccaaacctcagattactcttgctacatggccagtgtttacaagtgacctttcagcatagccataaccatatattccattctggggattaactgtatgaaacgtatgtacttgattcttaatataaagccctacctcaatgacagtttgggcagaaactgcaatagcaga

SEQ ID NO: 34356 - DNA, 366 bp, Homo sapiens
  misc_feature 2, 8, 345: n = A,T,C or G
tnatttanggcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagttttngatgcctgtatactggatatg

SEQ ID NO: 34357 - DNA, 277 bp, Homo sapiens
  misc_feature 26: n = A,T,C or G
tggatgtcagcagtacaagtagtgtngatagcgatgaagagaatgaagaactgaataaattgcaggcattacaggaaaaaagaataaatgaagaagaggaaaagaaaaaagaaaaaagcaaagaaaaaatcaaattgaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcccgaaaaaaaa

SEQ ID NO: 34358 - DNA, 321 bp, Homo sapiens
  misc_feature 3, 7, 32: n = A,T,C or G
tantatncagcctataaaaaaatgagatcacnttctctgcagcaacatggatggagctggaggccacgtatcctaagtgaactaatacagaacagaaaaccaaatactgtatgtgctccctataagtaggagctaaacactgagcacacatggacaaaaagaagggaataataggcaccagggcctatttgagggtggagggtgggaggagagcgagaactgagaaaatacctatcaggtactatgcttattacctgggtgacaaaataatctgtacaccaaaccccatgacatgcaatttacctatataacaaacctgcg

SEQ ID NO: 34359 - DNA, 498 bp, Homo sapiens
  misc_feature 3, 13, 33, 39: n = A,T,C or G
aanccaaaagggngcaaagcaccacctggtgtntatcangccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgac

SEQ ID NO: 34360 - DNA, 488 bp, Homo sapiens
  misc_feature 18, 19, 24, 34, 37: n = A,T,C or G
gtattcacatagaaaatnnaaggngtttcaatanagnagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcaagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgt

SEQ ID NO: 34361 - DNA, 407 bp, Homo sapiens
  misc_feature 22, 173, 174: n = A,T,C or G
aacactaacacctgtaataaanatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatnnaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatac

SEQ ID NO: 34362 - DNA, 316 bp, Homo sapiens
  misc_feature 9, 10, 35, 39, 58, 61, 62: n = A,T,C or G
gaagacccnngatatatatacaattaaaatatctntttnattatgttttaatgaagtntannttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttg

SEQ ID NO: 34363 - DNA, 265 bp, Homo sapiens
  misc_feature 24: n = A,T,C or G
atcaatgaggtccatcaatggctncttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtatgtgtgtgtacactgttcaatatggttcaatatggtaccaatagccacatgtgactatttaaattcattgcaatgaaataaaattaaaggtatactagcgc

SEQ ID NO: 34364 - DNA, 445 bp, Homo sapiens
  misc_feature 1, 2, 31: n = A,T,C or G
nnatgccgtaacaattcaggttttaaacctntttatccaaaagattcgagtaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatcc

SEQ ID NO: 34365 - DNA, 471 bp, Homo sapiens
  misc_feature 1, 12, 38, 40, 42, 66, 68: n = A,T,C or G
nacaagaacctnggaaaactaccgtgtggtgtgtactntncngtacctaaaataaatatttccaangncactattgcctctgcaaaattatgataagagtaaaaatagtggactgccactggaaaccccaagagcaggaaatttataatagaggattcatgctggaagtattaaaggttgtttatagacctaagtggttaataaggatgtgtgtattgatattgctttagttaactccaacttgtaaccaattttattagcaataaagtactcacaatgacttagaaaactcactgacacatacgaacttccaagcatcacacctactacctaggtaggaagtacctacctacttccaagcatcacaccactctagtgactaaaattcataaagtaaaaggaaaataatgaaataagttggtaaagtaggaaaccgtggaagatcatagatgtgacatagaatagtgtaga

SEQ ID NO: 34366 - DNA, 468 bp, Homo sapiens
  misc_feature 6: n = A,T,C or G
gaagancacacctgaggagaaagacctcaaagtatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctg

SEQ ID NO: 34367 - DNA, 455 bp, Homo sapiens
  misc_feature 33, 34: n = A,T,C or G
ctagaccctctctcctttaccaccatgcaggannagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaac

SEQ ID NO: 34368 - DNA, 122 bp, Homo sapiens
  misc_feature 14, 21, 50, 52, 74, 84, 86, 98, 115: n = A,T,C or G
cattgacccgggcntggaggnagtagtgcctgtatgtcctagctactcangnggctgaggtgggagcccaggantccaagattntngtgaactatggnctcactgctgcactccngggctgc

SEQ ID NO: 34369 - DNA, 384 bp, Homo sapiens
  misc_feature 5, 127, 135, 152, 248: n = A,T,C or G
acgtnctcttcatttttttcccatcatatggcattaataaacacaaatgaaaggagaggttatctaaaagtctattttgtatgattatttattttgcctgatggcaatgttgaagatgagatttgancacgtggnctcaggtgggtgtgacngctctataggtccctactgaccctgaggctctctgatttcatgattcagctgttgatcagattcagtgctttgcaaggttcacatccttgactggncttgacacgaaatgagtggccataattccgcattttagattcaatatccaggtgtaattgaccaaacaagaaaactaaagtgtagcccagattagagctcattttagtgaaaaaggaagcaggaagtaaactctta

SEQ ID NO: 34370 - DNA, 383 bp, Homo sapiens
  misc_feature 4, 10: n = A,T,C or G
cggnagattnccaatcccaatttgtagggtttctaggttatttttacagaattgcttgtttgcttcaactgtctcctacctctgctcttggaggagatggggacagggctggagtcaaaacacttgtaattttgtatcttgatgtctttgttaagactgctgaagaattatttttttttcttttataataaggaataaaccccacctttattccttcatttcatctaccattttctggttcttgtgttggttgtggcaggccagctgtggttttcttttgccatgacaacttctaattgccatgtacagtatgttcaaagtcaaataactcctcattgtaaacaaactgtgtaactgcccaaagcagcacttataaatcagcc

SEQ ID NO: 34371 - DNA, 358 bp, Homo sapiens
  misc_feature 10: n = A,T,C or G
gaggctcgangtgacaccgatggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatat

SEQ ID NO: 34372 - DNA, 334 bp, Homo sapiens
  misc_feature 6, 8, 39, 239, 241: n = A,T,C or G
atgtgncncattctaaaatatgcattataatttagcagncccatttgtgattttgcatatttttaaaagtacttttaaagaagagcaatttccctttaaaaatgtgatggctcagtaccatgtcatgttgcctcctctgggtgctgtaagttaagctctacatagattaaattggagaaacgtgttaattgtgtggaatgaaaaaatacatatatttttggaaaagcatgatcatgctngnctagaacacaaggtatgggatatacaatttgcagtgcagtgggcagaatacttctcacagctcaaagataacagtgatcacattcattccata

SEQ ID NO: 34373 - DNA, 496 bp, Homo sapiens
  misc_feature 7, 35: n = A,T,C or G
gaaaacncatctagcaaactgagttgtggagctgnctctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaactccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcgatactttttttttcttaattgcattt

SEQ ID NO: 34374 - DNA, 453 bp, Homo sapiens
  misc_feature 4, 5, 30, 31, 32: n = A,T,C or G
gcanncctgtgtcttccattcatactttannntacaggtcatttgagccttcacacaaataataacctatctggccaggagaattatctcagaacagaagtcatcagatcatcagagcccccagatggctacagaccatgagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtct

SEQ ID NO: 34375 - DNA, 363 bp, Homo sapiens
  misc_feature 1, 8, 40: n = A,T,C or G
nggtaggncccaaagggcaaacctgtagtaaccactgctntaaggaagtggaaagtttagaaatgctaccattgcctccacctgccaaatataaattaatgtgagctttttgagagacgcataacttactttgtctctgacttctccagttgtacccattttctcatttgttttgcacttacttgtatactatatgctggggaaaaagacaaaaatccctgtctttatttagtttgtaagcattcttcatttcccgaaggttggagaccttcggtctacaggtatcacagaaagtttaggaagtatgtaagccttaaaaggaaaaaatagtaagctttactctagcaaatgagtttatttgat

SEQ ID NO: 34376 - DNA, 460 bp, Homo sapiens
  misc_feature 10, 31, 44, 53, 58: n = A,T,C or G
aaccccgcgnctcttatggccggagaaaccncggtggaccttgnatgtgaacnaactntgtggcctttgaaagcggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaacaaaatacaaaaacccttaggacttctcatactctagccctgaccttgcagtctcctctgaggggcctcctaagacccttaaaataatattacaataggactttgagtgtgcatttcaca

SEQ ID NO: 34377 - DNA, 351 bp, Homo sapiens
  misc_feature 2, 5, 28: n = A,T,C or G
tnttnacttttttactcttttattcatnctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctg

SEQ ID NO: 34378 - DNA, 191 bp, Homo sapiens
gcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattgg

SEQ ID NO: 34379 - DNA, 191 bp, Homo sapiens
acaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactg

SEQ ID NO: 34380 - DNA, 304 bp, Homo sapiens
  misc_feature 1, 5, 151: n = A,T,C or G
ngatnattcttcagaggctcttcaggttctcctctgtcattcggtcagccgtctcagtccatttgcggaggaacattggtgttacagcagtggcatttaataaggaacttgatcctatacagaaactctttgtggacaagattagagaatncaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttga

SEQ ID NO: 34381 - DNA, 435 bp, Homo sapiens
  misc_feature 3, 15, 35, 39: n = A,T,C or G
gancacttccattcntggcaaaaatagtaactttnaagntagcttcaaggaagatttttggccatgattagttgtcaaaagttagttctcttgggtttatattactaattttgtttttaagatccttgttagtgctttaataaagtcatgttatatcaaacgctctaaaacattgtagcatgttaaatgtcagaatatagtagatttgttgtatatggctgtaccttcagaacccctaaaattaaaaaggaacatcaaatactgtcccaaaccccatatctaattatgttgatctaattgtctacaaaattagtgactcatgttgaggctgcttcacttatattttgctcatcgtcaagtggatttaggtctgcctaatcgctagatgtgtggtggatgcttttggcttatatatctggctgttggtttaacaga

SEQ ID NO: 34382 - DNA, 449 bp, Homo sapiens
agggggggggggagaccttgtcaaccatgaatcttacaatttttctcatagtaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcaga

SEQ ID NO: 34383 - DNA, 205 bp, Homo sapiens
  misc_feature 10, 13, 69, 70, 105, 138, 139: n = A,T,C or G
cataagggtntangtatgctgtgtatcccttcttataccctaagatgaagctgtttttgtgctctttgnncatcattggccctcattccaagcactttacgctgnctgtaatgggatctatttttgcactggaatatnngagaattgcaaaactagacaaaagtttcacaacagatttctaagttaaatcattttcattaaaagc

SEQ ID NO: 34384 - DNA, 179 bp, Homo sapiens
  misc_feature 15, 32, 168, 175: n = A,T,C or G
aattcgccctatagngagccgtatagacaaanatttactatcagttcaaaaaagacaaagcagaacgtagattacgcttataatgaagaacaaatccacaaatttgataagcaaaaactgtattaccatgccacaaaagctatgacgcactttacagatgaatgtgtnaaaaagnatga

SEQ ID NO: 34385 - DNA, 320 bp, Homo sapiens
  misc_feature 3, 15: n = A,T,C or G
ganagagggccgaanactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattg

SEQ ID NO: 34386 - DNA, 405 bp, Homo sapiens
  misc_feature 7, 17: n = A,T,C or G
aaggaanattaaccgtnttttggtccaacttcagatattttcttaatccagaagctgtgactgttcccagaagaaacctcttatatcacatttaaaacataaaaaataattacactttcactcattctaatgggtaaattgttgaattgtaataaacaactgtatatttacaaacaggtttataaggtatttgtctatcaaattaataataaaataaaacttacggggtctgcaaggaaaactatgaaggccacttaaagtggttcaggtatccctttgtcttgtagggcatagctgttggtttagccaggcttttacagtatttaattttaaagtatcctataactatcaacttcccaggttgaagacgatgtgttgagtttcctactgattgattgattcctg

SEQ ID NO: 34387 - DNA, 495 bp, Homo sapiens
  misc_feature 2, 17, 31, 34: n = A,T,C or G
gngcaaccttgtggatnctaggacccagacngtngtgcagataaagtctgacttttcagcatctagctccatgtgtcccaggccttacttatctgtaaagcaggcagtgtacaaccttgaaacatctagcaaacctagtatctaagttgtatgatttacaccacctttttgcattttgatgacacttgcattttaccaataatccttgactatttttatttcttaaagtcatgtgaactaaaaagtatttgatttaagacacttatttttctttaagccaatcaattagagctctttttatagacattgcacacaacacatatacagcaacgtgaacagacaaaagattcaacacttgtaagattttttatttgccagtttcttaattggattactggcttcagggtggagcccttggatgaacagggtcaggtagcatgcattaagactggtaagacaaaaaaatggagaaaagtaattcagttgactgataag

SEQ ID NO: 34388 - DNA, 250 bp, Homo sapiens
  misc_feature 27, 171, 172, 173: n = A,T,C or G
aattcgccctatagagagccgaatagntcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggannngtgtaactttaacgaacagcttgaaaatggtgggacatccttatcagagaaaacagttcttctgctggtgactccat

SEQ ID NO: 34389 - DNA, 352 bp, Homo sapiens
  misc_feature 21: n = A,T,C or G
ctgctcagaagataccgtgantctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagcctta

SEQ ID NO: 34390 - DNA, 133 bp, Homo sapiens
  misc_feature 18, 41: n = A,T,C or G
aaaagccaaaaaatgggngacaatttcacatggactttggnaaatatttttttcctttgccttcatctctcaaacttagtttttatctttgaccaaccgaacatgaccaaaaaccaaaagtgcattcaacctt

SEQ ID NO: 34391 - DNA, 215 bp, Homo sapiens
  misc_feature 2: n = A,T,C or G
tngaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacga

SEQ ID NO: 34392 - DNA, 159 bp, Homo sapiens
tagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatg

SEQ ID NO: 34393 - DNA, 198 bp, Homo sapiens
  misc_feature 177: n = A,T,C or G
ctttaaaggaaagacttctgacagcagaacctgtcagccaggaggagctgtcatccagtgactcatgagtccttctggattcttgtttaaactcatcaaggtgacttcagaacagaaagtcttttctaaaagtgctgaccttgaaaacaaagagtacattgattgatggtgtttggnattccctcatgcctctgcagg

SEQ ID NO: 34394 - DNA, 421 bp, Homo sapiens
  misc_feature 3, 154: n = A,T,C or G
canctggggagttatgggagatgctgaactggaattctgatattgggcagtgtgctcttctctgggaaactagaagttgtttttctgccagaggaatgacacagtgatgatttcccttggttttctttttgccacatacccgagactgggtgcnagagaaacaggcaacctagaaaggtcaacaggcacagaaaaagaaagtcttctagccagagaaccaggaaataggcaggtcagaacagtgttcgcaagccagaacactcttagaaagtaaccattctactgtagccaaacatcacagaaaaaattgtggctctgcttccacaatccccaggcagtaatgaagtagcaccctaccaccaccatttcccttgttggagtggagtgagaggaagccaactaaacagtggtttaaataaga

SEQ ID NO: 34395 - DNA, 338 bp, Homo sapiens
  misc_feature 25, 27, 28, 49, 210, 336: n = A,T,C or G
acgagactacttgaattcatcaatntnntgctttctctcatgagtttgngcagataaccactgatggccagatatctggggaaaaccagcagcatcagatagggctaagatgaaaaaagaaagtcatagaccaacaaaaacaggttatttagggaagaaaaattttaaaaaattctagttaatgtcctcagagattgatgaaagaatggnatctataaagaaagtacacggttttatgcaaaaagagaacaagaggaaattaaaaatatgattgcccctccctccctccattcaataaaaggctaggtttaaaagtagagcaaacagacaaagtanct

SEQ ID NO: 34396 - DNA, 392 bp, Homo sapiens
  misc_feature 2, 17, 150, 357: n = A,T,C or G
gngagctgagccctggncgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgnattcgggagtctttctttcgcgtggggccgcagtttgtagtgttttatcttatctacacatgggggactgaagagttcgagagatccaagaggaagaatccagctgcctatgaaaatgacaaatgagcaacgcatccgggatgacggttccctgtctctgaaagacctttctctggaagaggagtctgcatttgtagtgtctcaaanacacaataaacttcctatggtctgcactgttgtga

SEQ ID NO: 34397 - DNA, 270 bp, Homo sapiens
  misc_feature 21: n = A,T,C or G
cgcagttggctcacgcctgtncatcccagcactttgggaggccaaggctggtggatcacctgaggtcgggagttcgacaccagcctgaccaacatggagaaaccccgtctttactaaaaatacaaaatgattcaggtgtggtggcgcatgtctgtaatcccagctacccaggaggctgaggcagaatcgcttgaacctgggaggcagaggttatggtgagctgagattgcaccattgcactccagcctgggcaacaggagttaaattttg

SEQ ID NO: 34398 - DNA, 303 bp, Homo sapiens
  misc_feature 25, 26: n = A,T,C or G
tctgcaaaatagtgaattggtactnngggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgggtcctcattgagtttttgggtgatacagtttataaatataacaattatacaccctcatacattcgtctgattttgagcttgtaagatgagaactgctttttacacatttaataaaaaaaggtctctg

SEQ ID NO: 34399 - DNA, 351 bp, Homo sapiens
  misc_feature 25: n = A,T,C or G
gctcatctaagagaaatgagttcanaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatgc

SEQ ID NO: 34400 - DNA, 488 bp, Homo sapiens
  misc_feature 5, 6, 49: n = A,T,C or G
aagcnnatggcaactatttgaaagggattttgcaggatcgtggtctttncaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagact

SEQ ID NO: 34401 - DNA, 420 bp, Homo sapiens
  misc_feature 2: n = A,T,C or G
anttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttg

SEQ ID NO: 34402 - DNA, 309 bp, Homo sapiens
  misc_feature 25, 149: n = A,T,C or G
acagtcttggaccaagtggagattntcatggccatggaagacgaatttgggtttgaaattcctgatatagatgctgaaaagttaatgtgtccacaagaaattgtagattacattgcagataagaaggatgtatatgaataaagtatcangaccctttggctttgctgagagaggactcagatgatagtgacgaatgtctggcagtgaggacacattttggcattcttgctgactctgacagagtgattctgatggacttgtatttaaattgcatgtgttttactctttgaaaataaatctataaaacct

SEQ ID NO: 34403 - DNA, 426 bp, Homo sapiens
  misc_feature 4, 10, 38, 40, 64: n = A,T,C or G
tggncggggnggccagacaataaagaactgaagtgctntntactcagtgatttggaaattttgntgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacacaaataaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttg

SEQ ID NO: 34404 - DNA, 353 bp, Homo sapiens
  misc_feature 3, 9, 32, 36, 213: n = A,T,C or G
tgngtaccnttaaaatttagaacttcttttantttnaaaggcaaaaccaagtagtgaaaagataagcatcaaacttggagaaatattcacatataatcactaaatggttagtattcagaaaatataaagaacttctgtagccaaaagtaccatttatgaatctacttattgatggatgttttctgaacttcttttgcccagaggaaaaatagngcattaaaaagcttctgtccggccgggtatggtggctcacacctgtaatcccagcactttgggaggctgagataggtggatcacctgaggtcaggagtttgagaccagcctggccaacatggtgaaaccccatctctact

SEQ ID NO: 34405 - DNA, 214 bp, Homo sapiens
  misc_feature 2, 5, 161: n = A,T,C or G
anatnagcctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacngaattaacaaagacagtaatgtgaagagtgcattacactattcttattcttta

SEQ ID NO: 34406 - DNA, 441 bp, Homo sapiens
  misc_feature 3: n = A,T,C or G
agnggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcctcatggttattgagggcaagaaggctgcccaaagacacgagactttaacaagcttgaacttagaaaagaaagctcgtctgaaaga

SEQ ID NO: 34407 - DNA, 440 bp, Homo sapiens
  misc_feature 1, 20: n = A,T,C or G
nttgattggagaactaaggnatgttttaattctttatattctatcctgaattctgaaaattatagtgtaaaaggatgtgcaggctgggcatggtggctcacgcctgtaatcctagcacttcgggaggtcaaggcagaggattgcctgagcttaggagtttgagaccagcctgggcaacgtggtgagatcctgtctcaaataagtaaataaaaagatgtgcagaattacattttgcataatatatggggagcagtaagatctagaatatgaaactgttgtcactctggaattatcaacatggtactctgactgaattaaatattctcaaatgagcagaacaaaacctggtatccaaaaacttaagcaaagaaatagatttaaaaaacaaaaacaatgctgtaagaaatgaagtgggaattcatcaaattcaggaaagaaac

SEQ ID NO: 34408 - DNA, 471 bp, Homo sapiens
  misc_feature 176: n = A,T,C or G
ggaaggcggcggcggtggtggcttgtggtgcggcctcaccatacaggaacagggcagacgttagcgtgagtgatcactctcaatcccggagaatgattttaactgatcattgtactaataggaaggagtccaggtcatcctgagaagagttcgcttgtccagagtccaagatgcangatttgttggatttctataagccactcgaagccacatattcatttctgatgacagctttacacttgtgctggaagaacacccactgtgacaactgctgcctatgtttagtctgtccaggagctctaccaactagcatgtttgcagaaaaacctacactgttcttgttagcagctatgtaaatattagatctttctgagtttctcttctcagatctgccaatttctttggggcaaattgtatcctgcagtagcctcaatttaccctttgaaatgagggattaaaggttttagacat

SEQ ID NO: 34409 - DNA, 224 bp, Homo sapiens
  misc_feature 223: n = A,T,C or G
gaggcattgaggcagccagcgcaggggcttctgctgagggggcaggcggagcttgaggaaaccgcagataagttttttctctttgaaagatggagattaatacaactacttaaaaaatatagtcaataggttactaagatattgcttagcgttaagtttttaacgtaattttaatagcttaagattttaagagaaaatatgaagacttagaagagtagcatgng

SEQ ID NO: 34410 - DNA, 237 bp, Homo sapiens
  misc_feature 195: n = A,T,C or G
agaaaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcangaaaagactgtaaatagatccatccaaatgatttctctgtac

SEQ ID NO: 34411 - DNA, 251 bp, Homo sapiens
gcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagaga

SEQ ID NO: 34412 - DNA, 469 bp, Homo sapiens
ggactggctttagcagttttaaatttgctgaaaacagcagtcttagagttgtgttcaaaatgctttgaagtttgttaggcaatattttaaatattgaatttctgatttccaaacttcatgaatgtgtggaagaaaattggaagtttaaattgcattcaggtgaagatttagataattagaacgctagaagaagactatgagtgatttcatagtactcataaaaaagtgagttcaacttgcccacttcaaactgtagactaagatctgtttcctttgaaaactaaattttattttaggaaaaaatgccatagacagtgtcagattgaaggactaccacccctgggctcagtgactcacacctgtaattcctgcactttgggaggctgaggcgggtgaatcacttgaggtcaggagtttgagaccggcctggctaacatggtgaaatcctgtctctactgaaaatacaaga

SEQ ID NO: 34413 - DNA, 191 bp, Homo sapiens
cagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttact

SEQ ID NO: 34414 - DNA, 291 bp, Homo sapiens
  misc_feature 14: n = A,T,C or G
attctcagcagaantgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttacttgaacagtaacatagctgtgatttttggtatttgaaacactggttttaaatattttgacttgttgagggtatgttttatatagcaagacattatat

SEQ ID NO: 34415 - DNA, 488 bp, Homo sapiens
  misc_feature 1: n = A,T,C or G
ncgaaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgca

SEQ ID NO: 34416 - DNA, 224 bp, Homo sapiens
  misc_feature 224: n = A,T,C or G
catgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggn

SEQ ID NO: 34417 - DNA, 443 bp, Homo sapiens
aaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgc

SEQ ID NO: 34418 - DNA, 423 bp, Homo sapiens
  misc_feature 317: n = A,T,C or G
tggctcgggggttcgctggtggcgtcggagccgagccggactggtcaggatgatcacggacgcgcagcttcgccatcttcgccaacatgctgggcgtgtccgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctnagagtcttccttaatcctatggaacaagaagctgccacttgaatagggcccagtataggggcttgcttttctactccctccccccaatataaaaatatagacttcc

SEQ ID NO: 34419 - DNA, 255 bp, Homo sapiens
ctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagc

SEQ ID NO: 34420 - DNA, 274 bp, Homo sapiens
  misc_feature 15, 39, 112, 119, 221, 259: n = A,T,C or G
gaggccgggaaagtngaaaaggattagtgagctcgaagncatagcaaaagaactatccaaaatgaaactagagagaaaaagaaggcttagaagagcatttgtgagttgtggnacaactnttaggtagccaaccatacaatatacatggagttgccaaaggaaaggaaaggaagcagcagaaaaagagaataatgaataatgactgaaaattttccaaattngataaaaactataaaccaacagacccaagaagctcagngaaccccaaacacac

SEQ ID NO: 34421 - DNA, 325 bp, Homo sapiens
  misc_feature 18, 31: n = A,T,C or G
cagacgagctacctaagnaacagctaaaagnagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 34422 - DNA, 425 bp, Homo sapiens
atctgtgatgcccttcatccccacccaggtcagaccctcttcaccttacacctgcaatattagcacaggtgtgctctgacggggactccaaggtctcccaggagaagacaggctgagccagactcttaaaacaggatagagctgcttctcaaggccatttcctgagcacctgtcatgcgtcaggctatgggtgttccgcagggagcaggacagacaccatccctgccacaaggagcttgacatctcactatgtgcttctcagccgggtcaaatcaaggttctatgtgattctcagaaattcagagttcagcaggcgcagtggctcatgcctatcccagcactttgagaggccgaggtgggaggatcactttgatcccaggagttcaagaccagcttgggcaacaaagcaagacccccatttctat

SEQ ID NO: 34423 - DNA, 432 bp, Homo sapiens
cattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcgggtaatttgggtagagctttatcataatttgattttgtcatacaatttgaggatgtgcaaaaatatcctatgttggccgggtgcatggctcacggttgtaaccccagcactttgggaggccaaggttggagaattgcttgagaccaggagtttgaga

SEQ ID NO: 34424 - DNA, 484 bp, Homo sapiens
  misc_feature 23: n = A,T,C or G
attcccaatgctacacaaccagnaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgc

SEQ ID NO: 34425 - DNA, 353 bp, Homo sapiens
ggtaaatggagaggatatttcctgtcatagcccaagagtttccatttgatttagttctccgaagtcagggtgaatcggccttatgttcctgcctccagacccttttctcctgcctccgtggaatggatggcaggacatggaaaagtgttttgtccaaatgacatgtccaagggcactggcagctgaaggcaagagggaaccagttagtgccacggaggaatgcccacccccgtctccacaccgcacagaacaaagtgagtgtccttgtcctgaaccctctgagaagcagctctggaatttcatttattggcattaaaagcagaaaatggtcctatagagctcaatttaatggc

SEQ ID NO: 34426 - DNA, 428 bp, Homo sapiens
acattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactg

SEQ ID NO: 34427 - DNA, 296 bp, Homo sapiens
  misc_feature 26: n = A,T,C or G
gcatgttgatttaaggatgactcttnggggtccttactggtgtcaactgaaagactgactataactaaaagtattgaaaggtaactgaaggcactgaaagactgagtgaattcttggccagttaggtttttcccacggaatggccacatgatataacaaatagaacttaagccaggagacctgagttataagcaaatccaatatgcaaccaattattaaattactgaaacattttagttggttattagctataacatattggttggttaatagtaactgagctaagcattaaactc

SEQ ID NO: 34428 - DNA, 365 bp, Homo sapiens
attgatgttgtattttacactcttaagtcttaaccacagtcagaattatcttaatgtagattataattttggtcttttaggaaaaaaaaacaaaaatctgatatttatttcaaaacgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttg

SEQ ID NO: 34429 - DNA, 152 bp, Homo sapiens
  misc_feature 152: n = A,T,C or G
atacaacgattatctaaagccttactttaaatttatagatactagaataagcttattgacttagagatgctgcttaggaataaactattactctatcaacttttataaaaatatattttgccattttttaactattttagatattataagcn

SEQ ID NO: 34430 - DNA, 440 bp, Homo sapiens
  misc_feature 12, 14: n = A,T,C or G
gacaaccttagncnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 34431 - DNA, 235 bp, Homo sapiens
  misc_feature 2, 10, 29: n = A,T,C or G
tngcacctgnctcgctatgacagggagangaaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaacca

SEQ ID NO: 34432 - DNA, 106 bp, Homo sapiens
catcctcatgacatcatcgatgacatcaacagtggtgctgtggaatgcccagcccagttaagcacaaaggaaaacatttcaataaaggatcatttgacaactggtg

SEQ ID NO: 34433 - DNA, 288 bp, Homo sapiens
  misc_feature 24: n = A,T,C or G
gacagcaaaggggcgagccagaanctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatat

SEQ ID NO: 34434 - DNA, 445 bp, Homo sapiens
ataacaggtgttactgtaacatctgacaccagtaatccattttcaacttagttcaaagaactttccagtgattgacataatttagcatgtcttatggaggatatttttaatatgaagtaaccgaaaaacagcttccaggttatccaactatttacttggttctgctttatagttactgtcctccaatcttgtcagttattccagtcacaggttgaagagtgttagttgactgtgtgtatgaaaattgaacagaattggtcttggagggtttatgcattaagtgagaattagaggatcagttagttaaatatgcccagaggtttataaaatttacatgccatatgtgcatccagagagtgctcctggatgtatagtttgtttgtgaaatgccaaagcaaacatttcattaccataggtgcttagcaactaatcatgttgaggtttg

SEQ ID NO: 34435 - DNA, 120 bp, Homo sapiens
  misc_feature 40, 118: n = A,T,C or G
gaaggcagtagaggacacaggggatgactgagagtacagnagtagagagagagagagaatgagacagagacttaaggaagagaccctgtgagtctgacaataaaagatttggacaganac

SEQ ID NO: 34436 - DNA, 325 bp, Homo sapiens
atcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtac

SEQ ID NO: 34437 - DNA, 392 bp, Homo sapiens
caactcacaattatgctctaaagtgcatgctgtcacctaaatatgcaggcagaattgtgtctctgtctatttggtgtctatagtcctctatagtcacttctagaggggctagaccagatttctacaaactttatagggcagatattaatcattttacttcattccatgactcttttatcttcagaactgaaactgattcagagaccatggagcccagaaacctaatcagagtaacagtgtgcattgagtagacatggagacatgagaatctccacttcttttcccttctctcgctaaaatgctcacaattgcaggtaacaactgctgctactccacccatccgggacctaaatctgcagctctgaattctaaatctaggtctcgaaatttga

SEQ ID NO: 34438 - DNA, 325 bp, Homo sapiens
ggaaagcagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaccca

SEQ ID NO: 34439 - DNA, 393 bp, Homo sapiens
atttcagggtttggcagtatatttaacgttacaaaatattttagcttcttactttttttgttgttgcttgtttcctatttttcgcctcaggtatatggactcttggatagtccatgcatgaaagactttaatgccagttcatctctgaggttaaatacaaatgtgtgtgtgagtaacatttttctaaacgtagtaataatgtttttctaatgtgaatatgagagtctcaaagtagtctggaactccctcataaaaaaatccagttattgtttccactcaaacagtaaatcatcttggtagaccaaaggagaaaacctacgtggtatttttcctttaggaaatatccaaaatatgttctatatctattccatatcttaaaaaaaaagataagac

SEQ ID NO: 34440 - DNA, 450 bp, Homo sapiens
  misc_feature 6: n = A,T,C or G
agggcncttgtggaaaaagtgaaaaacattttctgaaaaacagctcttagaaattaaaactgaagaaatagaactaaaatcaccagaaagatttgaaaataaaattaaggaaatttactggaatattgggcagtaccgacagaaggatttttaaaaaacttagtccaggaactgtactaccagcttaatagttgtggacagaataaaagcagagggaattgcttaagaaaaaaatttgcagtactaaaggacattcatctttaggttgagcaggtcctacaagtgatcaggacagtgaatgaaaaagatccatacctaggcatacccctgtgaaattttagaacacgggggtggtgggggtgggtgtaggtcacagaattatgaatcagaatggcctaagactggtcagtaacaacgggggaagttgaagacattggagaaacatcctca

SEQ ID NO: 34441 - DNA, 452 bp, Homo sapiens
  misc_feature 17: n = A,T,C or G
agtgcaatcaaactagnaactcaggattaagaaactcactcaaaactgctcaactacatggaaactgaaaaacctactcctgaatgactactgggtacataacgaaatgaagtcagaaatacagatgttctttgaaaccaacgagaacaaagacacaacataccagaatctctgggacacattcaaagcagtgtatagagggaaatttttagcactaaatgcccacaaggggaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaactcttcaaaaaattaatgaatcccggagctggtcttttgaagggatcaagaaaattgatagactgctagcaagactaat

SEQ ID NO: 34442 - DNA, 431 bp, Homo sapiens
  misc_feature 27: n = A,T,C or G
aggcatcaccccgctaaatcccctagnaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcttat

SEQ ID NO: 34443 - DNA, 228 bp, Homo sapiens
gagaggccgccactagcaaacaacctcagcttcataaatccagcagaaaggtccggggtattgttgaaaaggtcggaaggaccaagattatgtccgccagcctaagtgggacgaacaaccaagttgtgcgatgcagcctttaaaggggctggtgattgacagaatggtgtagtagtagatggggtggagccgctgggtggggtcgagactggcagctgagagatacct

SEQ ID NO: 34444 - DNA, 490 bp, Homo sapiens
  misc_feature 29, 41: n = A,T,C or G
caggaattgaaaatggggctttccagggnatgaagaagctntcctacatccgcattgctgataccaatatcaccagcattcctcaaggtcttcctccttcccttacggaattacatcttggtggcaacaaaatcagcagagttgatgcatgctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctg

SEQ ID NO: 34445 - DNA, 336 bp, Homo sapiens
agttttgagtttgtgcctctttctaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaaga

SEQ ID NO: 34446 - DNA, 272 bp, Homo sapiens
gtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgc

SEQ ID NO: 34447 - DNA, 228 bp, Homo sapiens
  misc_feature 227, 228: n = A,T,C or G
ctgtttgaaatctttgctacttcccctaatgccaaaactccttcttgtgctatttctttcaggtttttttgccttttccattagactcactggaaatgatttgatagatttacagccttgttgattgaagtcttctcttatatataaactagtatataacttttatccccaaatataaatatattaattggtttttctgataacgttgtaaagcaaaagtcattgcnn

SEQ ID NO: 34448 - DNA, 222 bp, Homo sapiens
  misc_feature 2, 30, 32, 34, 48, 77, 108, 157, 185, 213: n = A,T,C or G
tngagggcccgggcatatggggtgataagnananaaagggagcaaggntaacgagagggaagcaaaagactaaaagnagaatgagactagagaatgaaagagggcagnaggatttcttaggaagtcaaaggatgccattttggataggaataaaggnataattaaggagaatctagagtcagggngaaaacccagattaacagaatgaactgnccttatttc

SEQ ID NO: 34449 - DNA, 175 bp, Homo sapiens
aactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgg

SEQ ID NO: 34450 - DNA, 463 bp, Homo sapiens
  misc_feature 24: n = A,T,C or G
ctttcttttttccggcgttcaagnatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 34451 - DNA, 237 bp, Homo sapiens
gttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagcca

SEQ ID NO: 34452 - DNA, 171 bp, Homo sapiens
  misc_feature 170, 171: n = A,T,C or G
gaaaggctcactctcaagccgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcnn

SEQ ID NO: 34453 - DNA, 402 bp, Homo sapiens
gaaaggcgataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactat

SEQ ID NO: 34454 - DNA, 115 bp, Homo sapiens
cactcagctgtcctgcagcaaacactccaccctccaccttccattttcccccactactgcagcacctccaggcctgttgctatagagcctacctgtatgtcaataaacaacagct

SEQ ID NO: 34455 - DNA, 430 bp, Homo sapiens
atggccagggcattcatgagaccaggctctgaaccctgtggggacggcctggctgcatctgtcaccttgagaaacaagtgattcagtggaaagctagacttgagggaggacaaatgtcctgcgtgtttttactattctttgattaaactgctccccacgtttgcaagaagaggaaggtgaaggagagaaggtttatatttcaaagttgaatcaccaacaatatccaataaatggttacattctcataaacagaaaattccaaaggaaaaaaaagcacaccccaaactcaccagaaggtaacgctccccataataggatttcatcacaacgcaaaagagtacaccttcactagttattgtccagttttttctcttagaggaaaaaaagttggtaaattctcctgagtccttcctggcatgcagtcaagcat

SEQ ID NO: 34456 - DNA, 411 bp, Homo sapiens
ggacctaaggagtcgcagttgtgaacaggttagagttacttgttattggtaaatagccactatggagactaaggaccagaagaaacacagaaagaaaaacagtggacccaaagctgcaaagaaaaagaagtggcatctgcaggatctccagctaggagacgaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaatagcggtagtggtgacggggcctccaaagttggaaagagcactttgatataatgcctcattcggaacttcacctggcagaagttcaccgagatcagaggccct

SEQ ID NO: 34457 - DNA, 468 bp, Homo sapiens
ggatctacttctcctcaaataggagataaggttgaatttagtattagtgacaaacagaggcctggacagcaggttgcaaccttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcgttacttgaggaagctgatcccaccatttactctggcaaagtaattcgccccctgaggagtgttgatccaacacagactgagtaccaaggaatgattgagattgtggaggagggcgatatgaaaggtgaggtctatccat

SEQ ID NO: 34458 - DNA, 204 bp, Homo sapiens
caagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 34459 - DNA, 255 bp, Homo sapiens
  misc_feature 14: n = A,T,C or G
actcaagcataagnacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctaccaaaatcatatattaaaattttctaacatc

SEQ ID NO: 34460 - DNA, 172 bp, Homo sapiens
aagaaatcctaaaaattcatgttgaaagggaatgattaaaacaatgtaaatctaaattgtatgtcatgcatgttttgagaatggtgaatgtttaatcctcatgaaaattgggggagggggttctattaacacaaagcttctgagatatttaaaataaataattattgccccg

SEQ ID NO: 34461 - DNA, 146 bp, Homo sapiens
  misc_feature 7, 24, 27: n = A,T,C or G
aaatganatcatttgctgggcagnagnatattagtgattgtgaaaaggaggatatgggaagtctaggtaaaataagttacttttgtgatttgttttttttgtaagtggtttttgaatatttgataattttaaaatttacttcaaca

SEQ ID NO: 34462 - DNA, 422 bp, Homo sapiens
  misc_feature 8: n = A,T,C or G
ggctcagnaagctctttaacaggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggggtggaatggggtggtgttagtcagggattactgacaggacggtgttccctactgtgttggagagactaagactggggaaagattctccaaggctgggaaatgcagacgtccagtcttggaaaacagtttgtcgttggtcgttatgtcagaagaggagtgtattcctggaagaaggcccacaaaatat

SEQ ID NO: 34463 - DNA, 179 bp, Homo sapiens
  misc_feature 11: n = A,T,C or G
agcacaaaagnatagacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgt

SEQ ID NO: 34464 - DNA, 467 bp, Homo sapiens
  misc_feature 17: n = A,T,C or G
attccttttccgtaatntatatcaccaaacagtctacttcagtcctctgcagttcttgcatctaatcctacaaatgcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtc

SEQ ID NO: 34465 - DNA, 266 bp, Homo sapiens
  misc_feature 4, 6: n = A,T,C or G
acancnaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagtc

SEQ ID NO: 34466 - DNA, 389 bp, Homo sapiens
gtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaaaga

SEQ ID NO: 34467 - DNA, 329 bp, Homo sapiens
  misc_feature 5: n = A,T,C or G
attcntaaaggtaccacacatatacacttctggtagttttctttcttcattttctaactattttgtgagtatgttaaatatttattgcaccttcatttttaatgaatttatctcccagtgcgtagctatagcaatgtttttagataagtaaccttgcacattttcattattttcaatatttcactgttacataaaataagggtgaccatcaaggttgattttgacttgagaaccaaaagttctcactggaggcaccaggaaaaaaaaaatgtagtattgcccatagtttttcatattatatacaatattatatacaatatattatatac

SEQ ID NO: 34468 - DNA, 348 bp, Homo sapiens
  misc_feature 12, 13: n = A,T,C or G
cgggacctaaannctttgggtgtattttctttaccctccaaggaaagaacctactagctacaaaaaatattttggaataagcattgttttggtataaggtgcatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacac

SEQ ID NO: 34469 - DNA, 315 bp, Homo sapiens
atgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtat

SEQ ID NO: 34470 - DNA, 287 bp, Homo sapiens
  misc_feature 3, 13: n = A,T,C or G
ccnaaatattacnacaagtcccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaaga

SEQ ID NO: 34471 - DNA, 137 bp, Homo sapiens
agtgttggtctcctagggaccaaggcctttgcatttttttctaccctgactcccacttctaatttctctttattgttattattattattttctctgctattgtaatatttttttgttaattaaatgttttggtcaca

SEQ ID NO: 34472 - DNA, 149 bp, Homo sapiens
tcgccaggctggagtgcagtgacacgattacggctcattgtaaccttgaactcctgggctgaacgattttctcggctcagcctcccaggtagctaggactacagatgcacatgcctggccggttttttaactttttgtagagacgagtg

SEQ ID NO: 34473 - DNA, 347 bp, Homo sapiens
  misc_feature 5, 10: n = A,T,C or G
tctgnggggncagtggtgtgggaccaaaatattcctaatgaaaaggaaagtacccaattagttgatttgttggtggcattcccccttttgggaaagcaatgtaaggttatgtctgtgtatgtcattcacacttaggcaagcatacacaggcaccatggctttaagaaccacactgatgcccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagattttttgggaaga

SEQ ID NO: 34474 - DNA, 342 bp, Homo sapiens
gagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttg

SEQ ID NO: 34475 - DNA, 315 bp, Homo sapiens
  misc_feature 15, 16, 28, 41, 62, 85: n = A,T,C or G
gggcccggggctttnnagcctctttagntaagatgtacacntgcaagcattcccccgttccnagtgagttcacccctctaaatcncccacgatcaaaagggacaagcatcaagcacgcagcaatgcagctcaaaacgcttagcctagccacaccccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgtttttagatcaccccctc

SEQ ID NO: 34476 - DNA, 110 bp, Homo sapiens
ctttggggtaaggatgtttgtgtgacaagtgcatgtgactttcagtgcctctcatgaattgacggctgctttggtggagtcagattgatgcttccctttgaactaactac

SEQ ID NO: 34477 - DNA, 498 bp, Homo sapiens
  misc_feature 9, 22, 25, 28, 37, 38, 43, 53, 71: n = A,T,C or G
cggcaatcnttgggcccggganggnaanctggggaannatgcnttaagtgccnatccctttgaatgttccnacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccggtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatggcattggtggtcctgat

SEQ ID NO: 34478 - DNA, 301 bp, Homo sapiens
tatggccgggggcgcgatcttggctcactgcaacctccgcctcccagtttcaaatgattctccttcttcagcctcttgagtagctgggattacaggcatgtgccaccatgcctaatttttgtatttttagtagagactgggtttcaacatgttggccaggctgctgttgaactcctggtctcaggtgatccgcctgcctcagcctcccagagtgccgggattacaggtgtgggccacctcgcctggcccatacaattttttaaagggcattgagatcctaaaattgaaattgtagatagat

SEQ ID NO: 34479 - DNA, 357 bp, Homo sapiens
  misc_feature 130: n = A,T,C or G
aagggaaaacatttcagttaacaaaagacatgatcaatgtgaagagattccagaaaacactatatgtggaagaagttgttccgaatgtaattgaaccttccttcggcctgggtaggatcatgtatacggnatttgaacatacattccatgttcgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgaga

SEQ ID NO: 34480 - DNA, 288 bp, Homo sapiens
  misc_feature 3, 11: n = A,T,C or G
gantagagaancccgaaataaacccaaatacttacagccaactgatcttcaacaaagcaaacaaaaacgtaaagtggagaaaggatacccttttcaacaaatggtgctgggataattggctagccacatgtaggagaatgaagctggatcctcctctctcactgtatacaaaaatcaacccaagataaattaaagacttaaatctaagacctgaaactataaaaattctaaaagataccattggaaaaatcattctagacattggcttaggcaaggatttcatgaacc

SEQ ID NO: 34481 - DNA, 133 bp, Homo sapiens
ctgtttgtttcaattggccatttaagtttagtagtaaaagactggttaatgataacaatgcatcgtaaaaccttcagaaggaaaggagaatgtttttgtggaccactttggttttcttttttgcgtgtggcag

SEQ ID NO: 34482 - DNA, 361 bp, Homo sapiens
  misc_feature 51: n = A,T,C or G
ctctcggccttagcgccatttttttggaaacctctgcgcccatgagagccnagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgttttatt

SEQ ID NO: 34483 - DNA, 115 bp, Homo sapiens
cagaaatgaatttcaaaggtagaaattgttggggaaaagtgcagttaacttttgtgttgagagactttggggtgctgcagatctctttatgaccaaagtgtctgctctaccctag

SEQ ID NO: 34484 - DNA, 154 bp, Homo sapiens
  misc_feature 16, 17: n = A,T,C or G
cccgggaaattcggcnnttatggcccgggagagatacagtgagaaattatgtgatctgtgtgttgtgggaagagaattttcaatatgtaactacggagctgtagtgccattagaaactgtgaatttccaaataaatctgaacacttgtctttac

SEQ ID NO: 34485 - DNA, 159 bp, Homo sapiens
  misc_feature 12, 37, 41, 43: n = A,T,C or G
tgttgcccgccngtgtttcccgtccgtaccgccgaantganantcggtttcatttaagttggacctaaatgctcttccttcagaggattatcccggggcatctactcaatgaaaaacccatgataattctttgtatataaaataaacatttgaaaaaac

SEQ ID NO: 34486 - DNA, 156 bp, Homo sapiens
  misc_feature 4, 13: n = A,T,C or G
ggcnagagagagncactttgcaccacagtacagatagcaagaagggaaagacagagagtgagaaaaaagaggagtcagtcgctcctggggaagggagagagtgagactgggagaaagagaagcacagaaagtgtgtgtaaaacggagtgaagaaag

SEQ ID NO: 34487 - DNA, 352 bp, Homo sapiens
atagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgcaaatttaactgttagtccaaagaggaacagctctttggacactagga

SEQ ID NO: 34488 - DNA, 274 bp, Homo sapiens
attgtttaatgggtgcgtggagtttcagtttgtgaaactgaaaaagttctggagatggactgtggtgatggttacaaaacaatgtgaatatatgtaatataattggactatatacacttataaatggttacatggtaaatgttatgtgtatgttacttcaatgaagaacataggggtaaactgttgaaagaatgcacattagtaaaggcatcacagttatgggatgagcttcagtacaatggaagcctggttccttacaggactgtactggtac

SEQ ID NO: 34489 - DNA, 188 bp, Homo sapiens
  misc_feature 12, 21, 26, 42, 45, 49, 52, 55, 59, 78: n = A,T,C or G
ccagggggaaanttcgggccnattantgggcccgggggggangantaanccnaanggcntgcttaccccctttggganggggcaccgttccttcttgcaagaaccttgccaacctcttgccccgcattcaggggttgttgaccgccaagggcgagcacctgaccctttagaattcagtcaccctgttc

SEQ ID NO: 34490 - DNA, 137 bp, Homo sapiens
  misc_feature 6, 13, 16, 20, 37, 45, 56, 60, 88: n = A,T,C or G
ccagcnacctacnacnaganaaaactacccgaatccnaaataacnagctacaaccncacnaagtaacattctaccacaacctcaaganaccacaccatttcaaaattacctacctcttaaaacaactacctcttgca

SEQ ID NO: 34491 - DNA, 257 bp, Homo sapiens
cttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaagggaggagtctgaagagtcagatgatgacatgggattt

SEQ ID NO: 34492 - DNA, 367 bp, Homo sapiens
caggaaatggaacttagtgaataaaaatgctcaaacttgccttgagtagtactttttattttttcatgtatacaataaatctggtttctgtgttcttcttgcaactccttatttgatgaacactcctaagtcttcatttgtagctctgtgagataaatgagattttagatccatttctattactattgattgaatttaccagttttgtatttgttgtaattacattaaaaggtgatatttattatttatggaatactttacccacgtatcagccatatgccatttagaacctgttttcccccaaacatatccatatttttaaaaggcctccaaagaagctgttatgttcatttcatttaaatgaaga

SEQ ID NO: 34493 - DNA, 222 bp, Homo sapiens
  misc_feature 61, 64, 67: n = A,T,C or G
ccaattccccatttcccgacattttggaaagttttgaccctttaacctgaaagaatgggangangangaattggaaaaaaagtgggagccatttcagaactttgtcttttcagcaagggactgggtcttttctatctctttgtactacactgaattcacccccactgaaaaagatgagtatgcctgccgtgtgaaccatgtgactttgtcacagcccaagat

SEQ ID NO: 34494 - DNA, 402 bp, Homo sapiens
  misc_feature 7, 10, 27, 36, 41: n = A,T,C or G
ccggccnttnttggcccggggagggcntttgaggcnagccngccgccaggggccttctgctgagggggccaggcggagcttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtttttaaaaagaaaaattgagagaaaaggactacagagcccccgaattaataccaatagaagggcaatgcttttagat

SEQ ID NO: 34495 - DNA, 328 bp, Homo sapiens
tatggccggggaacaaccgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttt

SEQ ID NO: 34496 - DNA, 392 bp, Homo sapiens
  misc_feature 6, 7: n = A,T,C or G
accttnnggtatttattgggaagcattttgtatattggaattgtgcctctgtgccattgccaagggagccctgagagaggaccctggttatatgagcatttcattccctttctcttgagagagggtgttggcatccttagaagctccctctttccagagcactgggccacgtggctgacttgctggctgccttcatttgatacctgtgaacactttcctttagcccacttgttctccatcggtggcgatttgccctcctcccaaaagacacatgacattttctaaagacagctgggagattcagctgtcatctaatggggtaatggccaaaggatgctgctacacacccaatacatccaggacggtccctcaacaaagaattatgtggccca

SEQ ID NO: 34497 - DNA, 374 bp, Homo sapiens
gaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcat

SEQ ID NO: 34498 - DNA, 168 bp, Homo sapiens
  misc_feature 5, 11, 36, 60: n = A,T,C or G
cggcntttttngccgggggtttcattgtacctgacnaccctcggttggcatcatggaccnatgaagaagcaagacgaaaacacacaggagggaaaatcctgggattctttttctagggatgtaatacatatatttacaaataaaatgcctcatggactctggtgcttc

SEQ ID NO: 34499 - DNA, 246 bp, Homo sapiens
  misc_feature 19, 120, 233, 240, 241: n = A,T,C or G
acagggtttcacccatgtnggccaggctggtctcgaactcctgacctcaagttatccacccccctcggcctcccaaagccttgggattacaggtatgagccaccacgcccagcccgaatntctgttgtttaaaaaccccagattctggtacttttgctatagcagcctgcagggactaaaacaggcactcaacaaacatctggccagagcttcctatgaggaggataccaagncaggagnncgaga

SEQ ID NO: 34500 - DNA, 333 bp, Homo sapiens
  misc_feature 1, 12, 20: n = A,T,C or G
ntggccgggagnggaaagangttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaagga

SEQ ID NO: 34501 - DNA, 284 bp, Homo sapiens
  misc_feature 4, 157, 162: n = A,T,C or G
cacnacctgttttctcttctggggttgatgatcacccttcaggaagcaaagctgatgaaggacaagggctcctcaccaaatagacacctagtggtgcctgtttctgacttcttgctttgatgttctcttttagggtccagataatttttttttttanaaaanaaatgtagagtgaaggtgacagcctttgattatagtagtaaagatgatccaaatagtttgtataataaatacttggacacatgaatctgtatttgaaatttgaaaccatcctaataatatag

SEQ ID NO: 34502 - DNA, 379 bp, Homo sapiens
gaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttta

SEQ ID NO: 34503 - DNA, 301 bp, Homo sapiens
  misc_feature 23, 182, 239: n = A,T,C or G
agttgagaaggaaattgaagaanttaatattttagaatgctgattggtaataatgctttaaaattacaggaaagtggtgagtttcactttatccatgttgaattttatgactgagatacaccctcagagataccccattctgcatctaaaaataggttaatagggctgggggacaatcttanggttggcacgtaccttattatttcattgaatgtgaaactatgtattttagaactcangaggttaaaatctgtaaagcattgttgaaatatagttcttagagtttgaagcatgttagttc

SEQ ID NO: 34504 - DNA, 288 bp, Homo sapiens
  misc_feature 1, 10, 30, 39, 67: n = A,T,C or G
nggccgggcnaaggtatttggcctgttctntagaatgcngtgattgtcccagctagctctgttaccnagcccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatggtg

SEQ ID NO: 34505 - DNA, 158 bp, Homo sapiens
  misc_feature 11, 13, 19, 53, 69, 79: n = A,T,C or G
atcttatcagntnattgcnctcttagatgtgctaagagtcagcttgcacaagntaagtccttgaggaangggctgccantgaaaaagccaagataaagtctgtctagctctcttagctaaaagaaagtcaattcaggtagaaacaaggctaagtgatt

SEQ ID NO: 34506 - DNA, 279 bp, Homo sapiens
  misc_feature 3, 17, 61: n = A,T,C or G
tcntaagttttttggcnttcttggtaagtttgtgtaaaagggttatttgagggccccagancctacctgaatttaaaccctctagaagaaagggaccccaaaaacccttatgtttttaagaaatgcctgcaggtaacctattaagatcaagtagggttgggcccgggagccagtgtctcatgccctgtaatcccagcactgtgggaggctgaggcaggcggatcacgaggccaggagtttgagaccagcctgatgaacatggtgaaaccccatctctac

SEQ ID NO: 34507 - DNA, 129 bp, Homo sapiens
  misc_feature 3, 4, 20: n = A,T,C or G
aannaaatagtgtttaaacnttgaatgtgttttgtgaacaatatcccactttgcaaactttaactacacatgcttggaattaagttttagctgttttcattgctcaataataaagcctgaattctgatc

SEQ ID NO: 34508 - DNA, 315 bp, Homo sapiens
  misc_feature 313: n = A,T,C or G
gcgacaacctcggtggtggccactgcgcagacagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaaagaggntt

SEQ ID NO: 34509 - DNA, 358 bp, Homo sapiens
  misc_feature 20: n = A,T,C or G
aatcttagatgtaaacattnaaatttaccctgtagacttgggtgacaagtttcggttggtcatagctagtaccttgtatgaagatggtaccctggatgatggtgaatacaaccccactgatgataggccttccaggtgagggagtggagaaggtaatacttgaaatatgccttgaggactaagtagataagtgatatagaaagactcttctaaaattcctggaataaatgatgatcagcagaatctgagtaaccttaaggaaatttctgcacttaagaattcaaacaggccgggcaccgtggctcacacctgtagcccaggcactttgggaggccgaggcagggaggattgcctttga

SEQ ID NO: 34510 - DNA, 387 bp, Homo sapiens
  misc_feature 3, 380: n = A,T,C or G
ganctgcgcaaaagcaatgcagcagaacgcagggggccctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagagtggttatgcctcctcgattgctccatactctaacatctagctggcttccctgtctattgccttttcctgtatctattttcctctatttcctatcattttattatcaccatgcaatgcctctggaataaaacatacaggaagtctgtctctgctatgggaatgccccatggggcatctcttgtgncttattg

SEQ ID NO: 34511 - DNA, 449 bp, Homo sapiens
  misc_feature 43: n = A,T,C or G
gagcctctactgactccaacgagcgcccaagaagaaaatggcntaagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatgggtgatgagattttccatgtggatatggcaaagaaggagacggtctggcggcttgaagaatttggacgatttgccagctttgaggctcaaggtgcattggccaacatagctgtggacaaagccgacctggaaatcatgacaaagcgctccaactatactccgatcaccaatgtacctccagaggtaactgtgctcacgaacagccctgtggaactgagagagcccaacgtcctcatctgtttcatagacaagttca

SEQ ID NO: 34512 - DNA, 325 bp, Homo sapiens
  misc_feature 5, 7, 74, 268, 316: n = A,T,C or G
tggcncnttccatctcttcttcagtaaacccaagtctgcagaatccaggcttttctgggaaaagtgaggccacncatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacanggggggcgggtgcaaaccagtgaacacctttgtgcacgagcccctggnaagatgtcc

SEQ ID NO: 34513 - DNA, 271 bp, Homo sapiens
  misc_feature 2, 4, 7, 8, 12, 18, 19, 25, 39, 50, 51, 58, 67, 69, 107, 179: n = A,T,C or G
cntntcnnggcntggagnngagggnccagggccggggangccctttggannggaaaancccgccagnantaaaagttttttttttttcctcctttttggaaaaggantaggaaggatttaaaataccaacctacctttaaaaaaaaatattaggtccaaataagggtttacctaaagantatttggctttagccgtttaaagtttttaaccgtaattttaatagccttaagattttaagagaaaatatgaagactttagaaagagtagcct

SEQ ID NO: 34514 - DNA, 288 bp, Homo sapiens
ggttaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttctttgggtgtattgcatgggctgcattatctacagcattgtacaataacaactagaaaaggcagtatacttcactgatgcttgtctggtaataatcacttctgtgttataatgg

SEQ ID NO: 34515 - DNA, 373 bp, Homo sapiens
  misc_feature 15: n = A,T,C or G
gattttagtgtaacnaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatagagtctcatggcacaagaagattaaaacagtgtctccaattttaataaatttttgcaatc

SEQ ID NO: 34516 - DNA, 347 bp, Homo sapiens
  misc_feature 6, 19, 35: n = A,T,C or G
accccngggaattcggccnttatggcccggggganattcagcccggcggttcggggcgacggactctccattccagaaccatggcccaatttgtccgtaacccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatgggttttggtggccactgaggtgttgatgtggttttat

SEQ ID NO: 34517 - DNA, 355 bp, Homo sapiens
  misc_feature 8, 14, 73, 334: n = A,T,C or G
aaaaaacnaaaacnaaaaccaaccaatccagtgttattggtattcacccataaaagatgaaaaacaaaaaacntaagccaactttctgatattagccctcagttcatggacttcggctatttcacattgagctttgggcgacaagttttgacagaaagtagaggttcctctcctgtggtcatgagcttgtgtttcaaggagttaatgttaagggtgccagaagtctctttcttctttatccagagaataagggggaaataaatacattttatacacacatactcaacatatatctatccacatatttatgcatatttatagtcattaatatgtnaaatatttccacatatctaac

SEQ ID NO: 34518 - DNA, 135 bp, Homo sapiens
  misc_feature 6, 7, 23: n = A,T,C or G
gggacnnaacatactagtacagncctatactccctctacatattgtaccacaacacaatggggctcactcacccaccacattaacaacataaaaccctcattcacacgagaaaacaccctcatgttcatacacct

SEQ ID NO: 34519 - DNA, 236 bp, Homo sapiens
  misc_feature 4: n = A,T,C or G
cacncacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccagggga

SEQ ID NO: 34520 - DNA, 357 bp, Homo sapiens
  misc_feature 80: n = A,T,C or G
tatgtgtttactattcttctatatgacttcaatgacttaatttttgtccgtgggaataattttactttttcttaattttnatcttatctattttacatgcttgttaatagaaataatgataatctcggacgggtgcagtggctcatgcttgtaatcccagcactttgggaggctgaggcgggcagatcacttgagctcaggagttcgagaccagcctggccaatgtggtgaaacctcgtctctacaaaaacacaaaaattagcagggtattggtggtgcacacctgtaatcccagctactcgggaggctgaggaaggagaatctcttgaacccgggagacatagattgcagtgagct

SEQ ID NO: 34521 - DNA, 114 bp, Homo sapiens
  misc_feature 3, 4, 6, 39: n = A,T,C or G
atnntnagggaactttcacccttaaaatctttctaagcnaagtgtgaataggatttttactccctttgtacagtattctgagaaacgcaaataaaagggcaacatgtttctgtg

SEQ ID NO: 34522 - DNA, 304 bp, Homo sapiens
gtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttat

SEQ ID NO: 34523 - DNA, 363 bp, Homo sapiens
aggtgaaattgagaaaaagaagaaaaactattcatctcaaaggaagggagctggagcatgaattataatcaccccagccacaccaaatccttcacattctctggtattctgactcatgttgtctgccatatgaatgttggcacgtgccattccagtagctcagatgcccttcccggtcctgcctgcccatctccctacggcagagcattatcctttcatcttcagcataactcttgtcttattctacaagttcccttttccccctgaggccaaggtaggagcccttcttttctgatgtctgcgtatgtacgtatttggttaattcagcaaatgatcaaatgatcaaatgatgggtaagaaaag

SEQ ID NO: 34524 - DNA, 148 bp, Homo sapiens
attaagaatgttgtgcaatattttggaatgggacattggtgtgtttagagattttagtttaaaaacaaaacaaaaagattgatcaaatctgtacagtttctattgttccagatttttttaagtttgtattaaaagcatgatacataat

SEQ ID NO: 34525 - DNA, 354 bp, Homo sapiens
  misc_feature 3, 209: n = A,T,C or G
gcnaggatggcaagaaaagctggcaacttctatgtacctgcagaacccaaattggcgtttgtcatcagaatcagaggtatcaatggagtgagcccaagggttcgaaaggtgttgcagcttcttcgccttcgtcaaatcttcaatggaacctttgtgaagctcaacaaggcttcgattaacatgctgaggattgtagagccatatattgnttggggggtaccccaatctgaagtcagtaaatgaactaatctacaagcgtggttatggcaaaatcaataagaagcgaattgctttgacagataacgctttgattgctcgatctcttggtaaatacggcatcatctcatgggagga

SEQ ID NO: 34526 - DNA, 300 bp, Homo sapiens
gagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgattttg

SEQ ID NO: 34527 - DNA, 108 bp, Homo sapiens
ggatccttttgtagttcatgagcgtgatgattgggtgttcatacgcttgtgtgagatgtgccacccttgaaccttgttacgacgtaggcacgttacccgtctgacctc

SEQ ID NO: 34528 - DNA, 251 bp, Homo sapiens
  misc_feature 18, 186: n = A,T,C or G
atgtagtaggacctcggngtccccactctctcatctctgggacttgatacttcctcattagtttaagatatgtttgcatgagttgctagactattcatattacatattacctattacatatcctcaagatgaattcagaaccagaatcttcttttaaaaatttgactacggagttaaggaggcagngagaagtttttattttcttgcctactgttttgctagagaattagctttgaaagttctggtgctat

SEQ ID NO: 34529 - DNA, 130 bp, Homo sapiens
catctacattaggtgtttctcctaatgctatccccaccataattacccccatactccttacactattcctcatcacccaactaaaaatattaaacacaaactaccacctacctccctcaccaaagccccc

SEQ ID NO: 34530 - DNA, 344 bp, Homo sapiens
  misc_feature 5: n = A,T,C or G
agagntttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaggagttctttcagattgatgggttatgtcactgaccatattggaagttgtccaagaccacagtgctctgtttaaggtgcttgcattctttgaaactgacatggagagacggtgcaagatgcataaacgcagaatagccatgctagagcccctaact

SEQ ID NO: 34531 - DNA, 304 bp, Homo sapiens
  misc_feature 23: n = A,T,C or G
gaaagtgggagaaagtctgtatnaatgggcattgggaaagcatatatttaaaacggactccttagtcaagaagggcatggttgaaaagtgctgaactggacactggaagacattggttcaagttttgcttctaccttgatttgttgtgtgaccttgggcaaattagtctctgaaaatcagtttcttcacgtgtggaatgagaatcactgtatctatctgcattgtctacctcgtagggtatatgagcttcaagagataatagtgttaactcaaatctagaaacttcttagtgctttagaaatgt

SEQ ID NO: 34532 - DNA, 443 bp, Homo sapiens
  misc_feature 22, 33, 34, 39: n = A,T,C or G
gaaatgagatgaaaccatgagnatgaaatgaannaatgncatgcaaatgatgagatgaaatgatgaaatgagatgagatgagaagaaatgacttgatgagatgagataaaatgatgaaatgaaatgaagtgaaatgaaattgaaatgagatgagatgaaatgagataaaatgatgagatgaaatgagaagaaatgagatgaaatgatgaaatgatgagatgagatgaaaaatgatgggatgagaaatgagatgaaatgatgggatgaaatgaaatgaaataatgaaataatgaaatgaaatgaattgataatattgaagtgaaattgaaagatgagattggatgaaatgatgagatgaaatgaaatgttgaaatgaaatgaagagatgtaacatgaaatgagctgaaatgatgagatgaaatgaaatgaaatgagattaaatg

SEQ ID NO: 34533 - DNA, 234 bp, Homo sapiens
gtacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatatc

SEQ ID NO: 34534 - DNA, 283 bp, Homo sapiens
  misc_feature 6: n = A,T,C or G
gagtcngcctgggtgacagagtgagacactgtctccaaaaatataataataaaaataaagcctgtatctcaatgggaagatttctgctaaggcagttcaactcactggaaagaactgctgcattaggtttcaactttaatgctttctgttacttctggtaaaggttaagtgatttttccattagctgtagaagtttggagagctatttaccaagccagatcaatgatttaaaaattattggaaattcatctaagaatcaagtctgaatgcccaattctattgc

SEQ ID NO: 34535 - DNA, 110 bp, Homo sapiens
  misc_feature 49: n = A,T,C or G
cgaggaagcagtaaaatcgttgtgaaagtgttgaaggcacaagcacagnagtcagaaagctaaataaaaaaatgaaacttttttgagtaataaaaatgaaaagacgctgt

SEQ ID NO: 34536 - DNA, 235 bp, Homo sapiens
  misc_feature 8, 43: n = A,T,C or G
tgtatttnatgggtgtggcagtgttacacaatggttcagaacnagggacttgaagtcaaacagttgctacttggaattccagcccagctacttgaccttgggtcaattattttaacctccctgagccctcgttgtcctcctctataaataatggacgatgatgatgcaccccagtgaatgacgattgtggaaaataacatatgtaaagtgcccagtgttatgattattattcctg

SEQ ID NO: 34537 - DNA, 338 bp, Homo sapiens
  misc_feature 317: n = A,T,C or G
gtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaagggagnacgctgctcccacggagggga

SEQ ID NO: 34538 - DNA, 265 bp, Homo sapiens
  misc_feature 22, 29: n = A,T,C or G
accctcgttgcactgctgagancaagatnggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatat

SEQ ID NO: 34539 - DNA, 199 bp, Homo sapiens
agtaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 34540 - DNA, 284 bp, Homo sapiens
  misc_feature 6, 153, 164, 167, 190, 208, 218, 246, 269: n = A,T,C or G
aacttntttgcgaaaaagacagggagacagtactgtcatctgcattataacggactgtgattggatcacatgagcaaattttcagctctcaaaggcaaaggacactcctttctaattgcatcaccttctcatcagattgaaaaaaaaaaagcnctgaaagccanttnctgaaaaaaaattgacagctagngttttttaccatccgtcnttacccaaanacttgggaactaaaatgttccccagggngatatgctgattttcattgggcncatggactgaatcac

SEQ ID NO: 34541 - DNA, 190 bp, Homo sapiens
  misc_feature 3, 4, 7, 15, 18, 20, 31, 36, 39, 40, 44, 55, 63, 66, 67,73, 81, 93, 137, 139, 178: n = A,T,C or G
aannacntccggccntcngnggccctccgantgaanganncgcnagcctaagccntgccgaanaannttaaantggtgaanttggccagggancacacttggatcactccgaccactttcgaaacgccactttgccngnccccccgggtttccctccccggggctaccgccctgtctngagccgtcgctt

SEQ ID NO: 34542 - DNA, 232 bp, Homo sapiens
atgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgc

SEQ ID NO: 34543 - DNA, 209 bp, Homo sapiens
  misc_feature 2, 11, 12, 31, 32, 38, 39, 42, 47, 59, 63, 70, 79, 91, 95,102, 104, 137, 152, 155, 174, 202: n = A,T,C or G
cnagccaagannaccctttctaccacccccnngggtcnntcnaactnggaccaaaagangaangggccanggaagaaanacttggaaagcnaagntcccctngnccccccccgggttttgggcagttgaaagggaanctgaaaatgaaaccnagnacaccacctgattgggganctgtatttatatttaaaaaatacctaanaaatacc

SEQ ID NO: 34544 - DNA, 337 bp, Homo sapiens
  misc_feature 16: n = A,T,C or G
tggcccggggaaaaantacattaaatttttagtgacatgtatgaatgcaaaacactaatactttttgactgatagactaattgaatccttagacatgacagaagtttgaaaggcagaatatgtgaattaatgtaattttaaattaattttcctctgcatcttaacggatctttatagtaaagccctgataaagtaaggtttcaaaatggtgattgatggtgtagggtaagaatttaatggatttaagtagttgcttacctggaatatgcttatttggtaattgtctgctttatttggacaaggcatcaatacattgattaaccggtagaaaaatatt

SEQ ID NO: 34545 - DNA, 379 bp, Homo sapiens
  misc_feature 8, 16, 48, 64, 75, 373: n = A,T,C or G
cccggganttcggccntttattggccgggcagtgtgtctgtaaaaacnaactcttccccagccnatgtggggccnaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagaatgcctctgtttcacctggagccaaggtggaaaggaagagttagccaccgtcatgcagccagctgccaagtagagacacaagagtgagggtggggctgctcactgaggaccacagttctgccaacatggctgggtttaattncttggg

SEQ ID NO: 34546 - DNA, 245 bp, Homo sapiens
  misc_feature 9, 10, 28, 44, 45, 46, 65, 70, 112: n = A,T,C or G
ctccggccnnctaatgggcccggggtgnccaaagtgtgcccccnnnggcttgtgtcctgccaaangggancgttgggagaaactgccagcctgctgtgcctgatgtgggaancagctcttctcccagatgttaatagaacaagcctgcaccaaccctggattttttttcaatacgatacctgagcccatttgctgcatttctttttatgttaaatatgtgagtgacaataaaacaattttgactt

SEQ ID NO: 34547 - DNA, 282 bp, Homo sapiens
  misc_feature 3, 13, 22, 33, 44: n = A,T,C or G
gancctcttagcnatcttgccnatcaatattanacttcaagacnaataaaagttcggttatttgttgtttttgtttttcttcacataagcacatacttttgtcttgctacattatgtgattgattgttttgacctgattttttctgttgaatgacaatttctggcttgaatatggaatcctgcttcaggaataaacagaaaacaccgctaatttctatagttgaaggatatcattggcttctggttgtatgtgccatggctgaagtgttttttgctattagc

SEQ ID NO: 34548 - DNA, 324 bp, Homo sapiens
  misc_feature 2, 15, 29, 33, 38, 42, 43, 51: n = A,T,C or G
tnattgggccgggcnagggtcaaagtacnagantagantacnnttgatacnaaagtacagaaaaatactttgatttttatccatttcttttactctgtgtaaagactttagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtaga

SEQ ID NO: 34549 - DNA, 318 bp, Homo sapiens
  misc_feature 20, 21, 31, 32, 48, 58, 59, 82, 89, 136, 147, 177: n = A,T,C or G
atggataaatagatacaggnnagtgaacagnnctagggctaagggctngaagactatnnccaagtgatagacgtggggcttnaggcatnatcaatcggacaaattcctaggaactgcggatattgctcgccacagnatcttatcagntaattgcactcttagatgtgctaagagtcngcttgcacaagttaagtccttgaggaaggggctgccagtgaaaaagccaagataaagtctgtctagctctcttagctaaaagaaagtcaattcaggtagaaacaaggctaagtgattaaaagaaaaggaaagtctaagaac

SEQ ID NO: 34550 - DNA, 127 bp, Homo sapiens
cttggtgttcccttgtttggaagaattatttcctctgaatttctgggcttggtcttccagttggcatttgcctgaagttgtattgaaacaatttaatgaaaatattaaatatttggtttcaaaagac

SEQ ID NO: 34551 - DNA, 318 bp, Homo sapiens
  misc_feature 3, 5, 297: n = A,T,C or G
cantntgtggaattgccctcagcagccagcctacccccactgtgtgagcctggtggacggtgatgaggaaggacttgactggggatggcgccatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattatttgattcacttactgactttgcattttcgtttttaaaaaggatgtangaaatttttacctgtttaaat

SEQ ID NO: 34552 - DNA, 239 bp, Homo sapiens
  misc_feature 2, 7, 37, 52, 84, 115, 116, 144: n = A,T,C or G
gntgtantatgaggaatgctgttgctctgattctggnactactttctaattnaagatcatgacatccctaccccgacttactgngttgaatattatttaaccacgcctcaagtcnnacacaagggtgatgagcccttgagagtnttcccagtcttatgttttcctttctgtgagttttcctttagtacattacaaaacatcatctaaatttgtgtcttaatagaatttgatagccttct

SEQ ID NO: 34553 - DNA, 110 bp, Homo sapiens
  misc_feature 5, 37: n = A,T,C or G
cctcnagcatttctgaaaaagctgcttcttattaatnctacaaactctcaccatgatgtgaagagtttcacaaatccttcaaaataaaaagtaatgacttagaaactgcg

SEQ ID NO: 34554 - DNA, 294 bp, Homo sapiens
  misc_feature 3, 8, 29, 36, 43, 53, 63: n = A,T,C or G
agntgganctcatggcccttgtaatcccngcacctntggggantgccccgagngccggggagngatcacaaggtcaggagatcaatacccatcctggccaaccacggtgaaacccccgtctctactaaaaatacaaaaaattagcccgggcgaggtggcgggtgccctgtagtctcacctactcgggaggctgaggcaggagaatggcatgaacccgggaggtgggagcttgcagtgagccaagatcgcgccactgcactccagcctgggcgacagaatgagactccgtctatt

SEQ ID NO: 34555 - DNA, 211 bp, Homo sapiens
  misc_feature 204: n = A,T,C or G
cagatttgcaattcggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaaanggggggg

SEQ ID NO: 34556 - DNA, 273 bp, Homo sapiens
  misc_feature 20: n = A,T,C or G
gtagcatgtctgatttgccnccctggatgaaaggcagacatcaacatgggtcagcacgttcagttacgggagtgggaaattacatgaggcctgggccctctgcgttcccaagctgtgcgttctggaccagctactgaattattaatctcacttagcgaaagtgacggatgagcagtaagtaagtaagtgtgggggatttaaacttgagggtgtccctcctgactagcctctcttacaggaattgtgaaatattaaatgcaaatttacaactgc

SEQ ID NO: 34557 - DNA, 274 bp, Homo sapiens
  misc_feature 16, 26, 33, 38: n = A,T,C or G
tccggccaatttaatnggcccggganataaggnggagngtgatagcattgctttcgtgtaaattatgtaatgcaaaatttttttaatcttcgccttaatacttttttattttgttttattttgaatgatgagcccttcgtgccccccccttcccccttttttgtcccccaacttgagatgtatgaaggcttttggtctccctgggagtgggtggaggcagccagggcttacctgtacactgacttgagaccagttgaataaaagtgcacaccac

SEQ ID NO: 34558 - DNA, 372 bp, Homo sapiens
  misc_feature 12, 39, 79: n = A,T,C or G
tcggccaattantgggcccgggtggccccttcatttacntaaaatattatactagcatttaccattctcacttctaggnaatactagtattatcgctcacaccctcatatcctccctactatgccctagaaggaataatactatcgctgttcattatagctacctctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgacttt

SEQ ID NO: 34559 - DNA, 327 bp, Homo sapiens
  misc_feature 4, 35: n = A,T,C or G
attngccggggggggtggggtgacaagtatttgcnggctggtatgaagctgaatcacaggaggctggaactgtacacagattgttggccaaagtcagagaagaaggcctctatgtcagttgcaggaacaattttagactgtagttgttaagagtatggactctggagtcgtgaattatagtcccaccactagcagccatggattttggcaaattattctactttccaatatctctgtttttccatctgttaaatgggcataattactatttctacaacacagacaatcatgagaacaaaatgaattaattcatatcaaacattttag

SEQ ID NO: 34560 - DNA, 191 bp, Homo sapiens
gactcagtaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatggggggaaaatatcagttatgagc

SEQ ID NO: 34561 - DNA, 194 bp, Homo sapiens
  misc_feature 7, 11, 17, 23, 33, 51, 194: n = A,T,C or G
ctgggcnaaanggcccngtatantactgggtanttcccctaatataacccngccttttgaaaatttatgtgtttggattagtgcccttctggttacccagtattgactctgctagtttgcaccctttccgttcttaacagaaaatttgtatttgttattcctcttaaattttgtcgtaactagtgaaggaagtn

SEQ ID NO: 34562 - DNA, 295 bp, Homo sapiens
  misc_feature 8, 17, 25, 44, 59, 113, 124, 132, 154, 166, 171, 203: n = A,T,C or G
tgaacagntctagggcnaagggctngaagactatccccaagtgntagacgtggggcttnaggcattatcaatcggacaaattcctaggaactgcggatattgctcgccacagnatcttatcagntaattgcnctcttagatgtgctaagagtcngcttgcacaagntaagnccttgaggaaggggctgccagtgaaaaagccnagataaagtctgtctagctctcttagctaaaagaaagtcaattcaggtagaaacaaggctaagtgattaaaagaaaaggaaagtctaagaac

SEQ ID NO: 34563 - DNA, 441 bp, Homo sapiens
  misc_feature 23, 40, 41: n = A,T,C or G
tggggcccggggggcccttttcntcgtttcccccggcccnntctttagtcggctggctggttgggttggggggcccgtccccgctccctaagggcaggaagaatggtggcccgcaaagaagacgaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactttgctatgttggctaaaactggtgtccatcactacagtggcaataatattgaactgggcacagcatgcggaaaatactacagagtgtgcacactggctatcattgatccaggtgactctgacatcattagaagcatgccagaacagactg

SEQ ID NO: 34564 - DNA, 179 bp, Homo sapiens
  misc_feature 1, 4, 27: n = A,T,C or G
natnggccggggtaccgacctcttagncggtggatcactcggctcgtgccgtcgatgaagaacgcagctagctgcgagaattaatgtgaattgcaggacacattgatcatcgacacttcgaacgcacttgcggccccgggttcctcccggggctacgtctgtctgagcgtcgcttgccg

SEQ ID NO: 34565 - DNA, 273 bp, Homo sapiens
  misc_feature 2, 19, 34, 37: n = A,T,C or G
tntatgggcccggggggancgttggtgccccagnacnggaattcggcttcgacgttggccctgtctgcttcctgtaaactccctccatcccaacctggctccctcccaccccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatga

SEQ ID NO: 34566 - DNA, 481 bp, Homo sapiens
  misc_feature 7, 20, 105: n = A,T,C or G
ctccccngggaatttcggcntttttggccgggatctgataattgtggaatacacattcttctctcagcacatggaacagtcttcaggatatacccacgttaggcncaagacaattctcaagatattttaaaaattttgaaatcaagtatcttctcagactacaataaaacttgaagtcaataaaagaaagaaactttagaaactagacaaatgcatgaaaattaaacaagatactcccaaataaccattgggtcaatgaagaaattaatatgaaaatcaaaacatttattgaaacaaatgaaaacggaaatacaacataccaaaacctgtcgtatacagcagaagcagtactaacagggaagaaaatagcaacaaacacctacatcagaaagttagggagttcaaataaacaatctaatgatacactgcaaggaactagaaaagcaagaataaactaaatctagaagtagtagaacaaaag

SEQ ID NO: 34567 - DNA, 497 bp, Homo sapiens
  misc_feature 13, 23, 42, 58, 72, 371: n = A,T,C or G
tcggccatttttngccggggctnaaacttagcccccaaaccnctccaccttactaccngaaacccttagccnaaccattttaccccaaataaagtattaggcgatagaaaattgaaaccctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatancttggttgtccaagatagaatcttagttcaactttaaatttgcccacagaaccctctaaatccccttgtaaatttaactgttagtccaaagaggaacagctctttggacattaggaaaaaaccttg

SEQ ID NO: 34568 - DNA, 177 bp, Homo sapiens
  misc_feature 3: n = A,T,C or G
agnctaaaactggacaaagacccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaagg

SEQ ID NO: 34569 - DNA, 360 bp, Homo sapiens
  misc_feature 4: n = A,T,C or G
ggcnccttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgctttcgttgggcctatgcaagaacaataaatgtctatcctaatttcagacccactcctaaaaactcactcatgggagctctgtg

SEQ ID NO: 34570 - DNA, 289 bp, Homo sapiens
ggctggttacttagaagctgttctttggcataggttaaattattcaaatcaccccgtaccctccagcatgtgtctggctagacctagcatcctgacggaggttcagagaagcattccccagtgagggattgcagaccctccatctgggcaatgaaaagtttatcttttacagttcagcggctctctctgttcttaggacattgctccacatacggctaatgaattatttagcgtcagtctgctggtccactctgttctgaagcttcttgctacaggaggtgatggtgag

SEQ ID NO: 34571 - DNA, 303 bp, Homo sapiens
  misc_feature 15, 49: n = A,T,C or G
ctgtgcctgcatgantgttattttgtaaacagatgacattttctgaccnggcacatgcccatccaattttctgtcaatcacacctgttgtataaagcagcagaactgaaggggaaaaatgattgttgtatacacctgaattgctttgcatggtctcatttgagataattgatgtaagaatcctgacttttttatatttggaaacatcaaataaaaatggaaaaaatgatcatggctttaaaaaaaaacaaaaacacacacacatgaactcagatttgcaaaccaggtttctgaaactttgggt

SEQ ID NO: 34572 - DNA, 120 bp, Homo sapiens
  misc_feature 2, 13, 14, 38: n = A,T,C or G
cnccctggaagcnntttgtttctacctttgatatgacngtttttcggacagtttatttgttgagagtgtgaccaaaagttacatgtttgcacctttctagttgaaaataaagtgtatatt

SEQ ID NO: 34573 - DNA, 319 bp, Homo sapiens
  misc_feature 3, 21, 32, 39, 41, 49, 68, 83, 121, 137, 178, 190: n = A,T,C or G
aanggataaattgatacaggnaagtgaacagntctaggncnaagggctngaagactattccaaagtgntagacgtggggcttnaggcattatcaatcggacaaattcctaggaactgcggntattgctcgccacagnatcttatcagttaattgcactcttagatgtgctaagagtcngcttgcacaagntaagtccttgaggaaggggctgccagtgaaaaagccaagataaagtctgtctagctctcttagctaaaagaaagtcaattcaggtagaaacaaggctaagtgattaaaagaaaaggaaagtctaagaac

SEQ ID NO: 34574 - DNA, 372 bp, Homo sapiens
  misc_feature 34, 70, 81, 105, 136, 191, 316: n = A,T,C or G
ggaaaaacttttttttttctatagaacttttttngataacatcttctgagtcataaccagcctggcagtntgatggcctanatgcagagaaaacagctccttggngaattgataagtaaaggcagaaaagattatntgtcatacctccattggggaataagcataaccctgagattcttactactgatganaacattatctgcatatgccaaaaaattttaagcaaatgaaagctaccaatttaaagttacggaatctaccattttaaagttaattgcttgtcaagctataaccacaaaaataatgaattgatganaaatacaatgaagaggcaatgtccatctcaaaatactgcttttacaaaagcagaat

SEQ ID NO: 34575 - DNA, 335 bp, Homo sapiens
ggagttcggcggtcccgcgggtccgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctgg

SEQ ID NO: 34576 - DNA, 301 bp, Homo sapiens
  misc_feature 3, 4, 276: n = A,T,C or G
ganngcatggttgctctattggactacccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcgtttattttgactggtgatttattttgggagtggaggcattgtttttaagaaaaacatgtcatgtaanggttgtctaaaaataaaatgcattt

SEQ ID NO: 34577 - DNA, 364 bp, Homo sapiens
atatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgt

SEQ ID NO: 34578 - DNA, 325 bp, Homo sapiens
  misc_feature 5, 6, 30, 38, 45, 47, 55, 58, 68, 74, 89, 143, 154, 184,185, 201, 233: n = A,T,C or G
gattnnatggataaatatgatacaggtaantgaacagntctaggncnaagggctngangactatcccnaagtgntagacgtggggcttnaggcattatcaatcggacaaattcctaggaactgcggatattgctcgccacagnatcttatcagntaattgcactcttagatgtgctaagagtcnncttgcacaagttaagnccttgaggaaggggctgccagtgaaaaagccnagataaagtctgtctagctctcttagctaaaagaaagtcaattcaggtagaaacaaggctaagtgattaaaagaaaaggaaagtctaagaac

SEQ ID NO: 34579 - DNA, 236 bp, Homo sapiens
  misc_feature 1, 4: n = A,T,C or G
nggntggtgaaagttcttgctctacgtacctcctgctggcccttttgcgccctgtgcagtgggactgattgccgtgggtgtcggggcacagcttgtcctgagtcagaccataatccagggggctacccctggctctctgttgccagtggtcatcatcgaggtgggtgtcttcctctcctggtggtttttgtgggctgctgcggggcctgcaaggagaactattgtcttatgatcac

SEQ ID NO: 34580 - DNA, 305 bp, Homo sapiens
  misc_feature 3: n = A,T,C or G
acnactggaagcacagaaaactagaatttcgtttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgc

SEQ ID NO: 34581 - DNA, 241 bp, Homo sapiens
  misc_feature 11, 12, 30: n = A,T,C or G
tgggccggganngtttgaaaatatattctnataattctgtaaatataatcaattcaattattaggacagactagatttcaactaacatataattaagtacccatgccttatgtcttgtataatggccaaaatctagtttaacaccctgcttaactacacattaatcaaaactttaacataataataaaaattatcctttaattgactgtcaagtttagcacaaactccaaaactgcatagc

SEQ ID NO: 34582 - DNA, 287 bp, Homo sapiens
ggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgaga

SEQ ID NO: 34583 - DNA, 406 bp, Homo sapiens
  misc_feature 20, 26, 30, 36, 38, 46, 50: n = A,T,C or G
cccccgggaaatttcggccntttttngccngggagncnttgaggcngccngcgccaggggccttctgctgagggggcaggcggagccttgaggaaacccgcagataagtttttttctctttgaaagatagagattaatacaactacttaaaaaatatagtcaataggttactaagatattgcttagcgttaagtttttaacgtaattttaatagcttaagattttaagagaaaatatgaagactttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttaga

SEQ ID NO: 34584 - DNA, 218 bp, Homo sapiens
  misc_feature 51, 58, 64, 72, 79, 88, 95, 102, 116: n = A,T,C or G
agactcctatctctcagcacatacaacaaatcatatgcgagatagattgangacttanacgtcngacctganactttantactagtangtaaaantaggganatgccccaattaanagacacagactggcaaattgggtaaagaagacccttctgtgtgctgtattcaggagacccatctcacatgcaaaagacatgcataggctcaaaataaagaga

SEQ ID NO: 34585 - DNA, 111 bp, Homo sapiens
ctttctgagatctgcttttagtgaagtggatcaatgatgaaactagccaaatctgagcatcagaagtctttccagtctacctgatgcatgatctctacagttctgagaagc

SEQ ID NO: 34586 - DNA, 190 bp, Homo sapiens
  misc_feature 164: n = A,T,C or G
ataaaagcagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagngttttctgccacagacctttgggctg

SEQ ID NO: 34587 - DNA, 341 bp, Homo sapiens
  misc_feature 172, 217, 274, 298, 304, 313: n = A,T,C or G
ggaagatgggcgcaccctgtctgactacaacatccagaaagagtccaccctgcacctggtgctccgtctcagaggtgggatgcaaatcttcgtgaagacactcgctggcaagaccatcacccttgaggtggagcccagtgacaccatcgagaacgtcaaagcaaagatccangacaaggaaggcattcctcctgaccagcagaggttgatctttgcnggaaagcagctggaagatgggcgcaccctgtctgactacaacatccagaaagagtcnaccctgcacctggtgctccgtctnagaggngggatgcanatcttcgtgaagaccctgactggtaaga

SEQ ID NO: 34588 - DNA, 417 bp, Homo sapiens
  misc_feature 9, 11: n = A,T,C or G
ggaaaaaananatctcctcactaatagagaataatataaattgaactacagtcttgtgatgccttcttataaaactgtcaaaagttgtaaaaaaatgctcttttccagtgaggataagtgtggccaaatactctgctgaagagtaaatggatacaattttctgtaaggcatctggcaatgtgtagcaaaagctcgttgacccagaaatttatcctaaggaaaaacatcagaattgcacacaaagatttataaacaaaccttatcaaaatgtttctttataatagcagaaaattgcaattaacttgaatttctccaagctggctaaagaaatcatggtgcatccctagagggaatactgcagcagctgtttccaatcctgttctcagataaggctgtgggaaattgctcaatgcatga

SEQ ID NO: 34589 - DNA, 236 bp, Homo sapiens
  misc_feature 6: n = A,T,C or G
gaagcngcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagact

SEQ ID NO: 34590 - DNA, 284 bp, Homo sapiens
  misc_feature 3: n = A,T,C or G
acnaggggatagctcaagccttcatgaggaatctgatacaaacacttcccaccaggccctgcctccaacatcgaggattacatatcaacatgagatttggaggggacaaatgtccacactatattaataaggatataaagaaaaaaatatttttgtacagctgtactatgtgtttgtgttttaagctgtatgattagaaaatagtcaaaaagttagaaaatttaaaagtttatgaagtaaaaaagtaacagtaagctaaggttaatatattattgaaaaaatat

SEQ ID NO: 34591 - DNA, 227 bp, Homo sapiens
gtttccccagtttatatttttgtgtgcttagttaacgatcagttggttgtaaatagttggctgtatttctgggttctctattctgttccattggtctatgtgtctacttttataccagtaccacgggtacactaaaatctcagacttcaccactatacaattcatccatgtaaccaaaaaccacttttaccccaaaagttactgaaataagtatttttaaagatttt

SEQ ID NO: 34592 - DNA, 334 bp, Homo sapiens
attccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccct

SEQ ID NO: 34593 - DNA, 104 bp, Homo sapiens
gtttaatgagagtcctaatatttctcatctttgctgaccaaatatcttaggggaatgtaaatttgagaaaatagaagaatcttcactgagctcaagtggatgcc

SEQ ID NO: 34594 - DNA, 357 bp, Homo sapiens
cacctaccactgcaagtaacagcattgcatacatggtatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccat

SEQ ID NO: 34595 - DNA, 494 bp, Homo sapiens
  misc_feature 8, 13, 47: n = A,T,C or G
tgatggancgggnacgaacctgatctcttatactagtatccttaatnatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccgcctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaac

SEQ ID NO: 34596 - DNA, 366 bp, Homo sapiens
  misc_feature 21: n = A,T,C or G
tatggccgggattgggaagantgagaactgtacaatatgtatcacgtggtatttattaacctttgagttaggaatatgacttgattttcaggcactcatcactagaaagcactcacaagagcttctgattggaagagaaagatgattagattaccctgtaagaagccagcagaaattgatgctatcactttaggaaaggcgatcctgcctcctccacgggtgtgagtgaatcccctcttccctttacacaattaatggatggtttataattaattgttaaatgacttccctttttgctaagtgaccttaagtgagtcatttcccttctgtcttatctcttaagtggctgtattacttgttcaatga

SEQ ID NO: 34597 - DNA, 240 bp, Homo sapiens
aagaatggggattgggtgttggtgggtggtttgggccatgcaaaggagtcaggattctgagattttgggtagctgagattgtgacaagagggacttttgaggtcagtgattctagatgggttactttcctggaagccatatgccttgtgtgggcactattactatcaatttctacttaatgaacctctgtatgtggcacttttggggttcagtttttccccatgcacaaggccagagaga

SEQ ID NO: 34598 - DNA, 422 bp, Homo sapiens
  misc_feature 3, 14, 23, 24, 38, 40, 44, 49, 58, 66: n = A,T,C or G
gtnccccgggaaanctccggtcnnttattggccgggangnagantgccntttgaagancccaggcnccatagaaagagtagaatgcccacgtaatgacaacacagatattagagttacgtatctgcaagtcaaggaatgacaagggttgctggcaatcaccagaagctgggagagagagcatggcttttcagataggacaatgatttttggacttccggactctgacactttgagcaaatcaatttctaaggtacccagtttgtggtactttgttatggcagccctaggaaactaatacaatggaaatttgggcagggaatgtaagaagatgagctagtttataagatattttataagataaggtagcttaagaaagctggcagtgacaatattttctcatatgtaattgccagtcatatgc

SEQ ID NO: 34599 - DNA, 408 bp, Homo sapiens
  misc_feature 2: n = A,T,C or G
anggcattcatttaacaggtgttaactatttttattctcacaatacattgtttgaggcagataatactaatttccccactttatagatgagaaaactaaagctcgggatgttatgtaacttgcccaagccacacataataacagtggcataaccagaattcagaatttaaatccatacagtctgtctttgattccatgctgtctatcctgtttaacttttacatgacaaagatatcttttacagcattaaattgcaccagggaactctaacccatctggcccgggtcagaaaagggacaaaatgtcaacttttaagtattcaaaaatgggtattttgtttctttcatttattcatttgctatgtagcaatcaccattgtataatatctccataagaagatattgtttg

SEQ ID NO: 34600 - DNA, 125 bp, Homo sapiens
  misc_feature 5: n = A,T,C or G
atttnaattaattgggattatatatggctttgttagaccaaaatattcagtgatgagaacaacctttaaaaattagtgtgttttgcattagacacctaactggataaatacaaatagtcttttag

SEQ ID NO: 34601 - DNA, 407 bp, Homo sapiens
catactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataaggggatgtgg

SEQ ID NO: 34602 - DNA, 382 bp, Homo sapiens
  misc_feature 5: n = A,T,C or G
agggncttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacagctcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatgggatgtga

SEQ ID NO: 34603 - DNA, 390 bp, Homo sapiens
  misc_feature 3, 8, 20: n = A,T,C or G
gangaccntgccattatgtnttgattatgatttctctctttaagcatcatccaatccctgaattgtcacttatattaattaggcatttctttcctccacatcctttttttcttcctcttacatagtctgacagacctggactaaaatacaataatgcatctttcattgtaaccatctatatgtcttttagacacaaatacctaaagatacagggcttcaataaacttaactatctgtaaagttttaatgtataactccactagtaactttacataaaatgtgagggaaaatacctatatataattattatcataaaacagtggcataaagaaaaaatagtaacaatatatgttgaaaaaattcataatattcttcgattttgtgtttttt

SEQ ID NO: 34604 - DNA, 239 bp, Homo sapiens
  misc_feature 6, 19, 24, 34, 35: n = A,T,C or G
ggcganaaacctaccgagnctggngatagctggnngtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 34605 - DNA, 135 bp, Homo sapiens
gagtgatgacgcgactctcacgtgaccaggagtcgacgtgtgcagaagtccttatagtccagggcctgtttccctgtagcagctccttattgctggagaaggagaaaagtgcccaagatcctttcaggattaatt

SEQ ID NO: 34606 - DNA, 343 bp, Homo sapiens
caaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctc

SEQ ID NO: 34607 - DNA, 115 bp, Homo sapiens
  misc_feature 11, 15: n = A,T,C or G
agtctcacagnaatncccctctacctttgatattccacttagctgtagagtccatctgtttgtccatctgctgaaatgagaaaagaaaaatttatgcactgatttaaaacaaacc

SEQ ID NO: 34608 - DNA, 288 bp, Homo sapiens
aattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctgggga

SEQ ID NO: 34609 - DNA, 411 bp, Homo sapiens
ggagaacatcccagtaacccgacaccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcaagacctccgtgcccgaccatgtcgtctggtccctgttcaacaccctcttcatgaacccctgctgcctgggcttcatagcattcgcctactccgtgaagtctaggacaggaaagatggttggcgacgtgaccggggcccaggcctatgcctccaccgccaagtgcctgaacatctgggccctgattctgggcatcctcatgaccattctgctcat

SEQ ID NO: 34610 - DNA, 202 bp, Homo sapiens
atctcagggctaagtagaatgatatctgatgaaatctattccatctcagaaataaagcaactttatctcagaagattgcagggctgtacatatttgtctgtgaaatgtagctggagatactgaaaagtttaatggtaattcctgggggttagttttttgaagacccccatataatttggagagtgtgccacttactctgcac

SEQ ID NO: 34611 - DNA, 411 bp, Homo sapiens
  misc_feature 320: n = A,T,C or G
ggagcggagcaaaaaaaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccanaagttcctgatgaccgcgacttcgagccctccctaggcccagtgtgccccttccgctgtcaatgccatcttcgagtggtccagtgttctga

SEQ ID NO: 34612 - DNA, 100 bp, Homo sapiens
tatcaatatgcttaatggttctttgtacaattttgaaagtttctacctgtatataatggatgttaaccagtatcaataaatcacttcgtataatcttaga

SEQ ID NO: 34613 - DNA, 359 bp, Homo sapiens
aaggcacactgagggcatgccgacagccattatgattacagaagatacaagctaatgttggttgttccagatgtaattttgcatttctcataagaaatgctgttatatctgggatgtaaatttgactggtgtcctgtacttaatgctgttttacaggtgattcacataacaggccggctacgcctgagagtgtcgctgtcccacgggaggaccgtccccagccaaatcatgggtctcgttggttgttgcgcatgccttgcctccccctacgatcaatgaagtcagaattgactgccatatgttcgtcactcgagtaaatatggacctcaatatcatttactgtgaaaataggtactttg

SEQ ID NO: 34614 - DNA, 377 bp, Homo sapiens
  misc_feature 1, 32: n = A,T,C or G
naccgtaggtggcctgactggcattgtattancaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaaccttcttcccacaacactttctcggcctatccggaatgccccgacgttactcggactaccccgatgcatacaccacatgaaatatcctatcatctgtaggttcattcatttctctaacagcagtaatattaataattttcatgatttgag

SEQ ID NO: 34615 - DNA, 154 bp, Homo sapiens
aataaaaagaaattttgcctgccttttcgaatctcttttgaagctttctgttgatgttaactgagctactagagatattcttatttcactaaatgtaaaatttggagtaaatatatatgtcaatatttagtaaagcttttcttttttaatttcc

SEQ ID NO: 34616 - DNA, 471 bp, Homo sapiens
ggctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaacctt

SEQ ID NO: 34617 - DNA, 433 bp, Homo sapiens
agtcgccgccatgacgaccgcgtccacctcgcaggtgcgccagaactaccaccagggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacgtttggaaaaaaatgtgaatcagtcactactggaactgcacaaactggccactgacaaaaatgacccccatttgtgtgacttcattgagacacattacctgaatga

SEQ ID NO: 34618 - DNA, 321 bp, Homo sapiens
cacccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgtttcccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacac

SEQ ID NO: 34619 - DNA, 127 bp, Homo sapiens
  misc_feature 2, 7: n = A,T,C or G
tnagcangctgatgaataagatctaagagttacctggctacagaaagaagatgccagatgacacttaagacctacttgtgatatttaaatgatgcaataaaagacctattgatttggaccttcttct

SEQ ID NO: 34620 - DNA, 285 bp, Homo sapiens
  misc_feature 8, 10: n = A,T,C or G
gtaaaacngnaaaaaatgcatctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaat

SEQ ID NO: 34621 - DNA, 392 bp, Homo sapiens
atgagcaccatgtatttgacatgctttcatttaggttagtttatgctacccaatcctgtaagaatttatctgcataactagatagaatttatccagcaattgactgaatatcttatttgttggatttatgtgcattctaataacatttggttcttagttccaatagtgtgtataaatactaaatataatatttcataccaggaccagttattagagaatatcatcagataactataatttgtactcttttatctacttttatggctgactcacattgttttctcccccctctttgccatttgtttactatattccaaattgtttttaaacagttacacaagggattatgtcccttgggaatggtccgttacattttgaatatcagtgccatt

SEQ ID NO: 34622 - DNA, 378 bp, Homo sapiens
  misc_feature 16: n = A,T,C or G
aagaaaagctagtttnaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgaga

SEQ ID NO: 34623 - DNA, 362 bp, Homo sapiens
gggcaaccatagtgagatcctgtctctaaatacaagaagaaaaaaagacttactataaagctacaatagttacaacgatgcagtttggaaacaatgatagacataagtcaataggacttatgtcccgaagagtccaataacaggcccatacatgtgtggacacttcatttatgatgaagatggaactgaaaagttggtcttttcaataaatgatattggatcaattggatattcatgtgaaaaaaatggaatttcaccttgcactcataatcatatacaaagatctatttcaaatggactgtagatctaagtataaaaggtaagagaataattattctagaaagtaaatgtattttctaaga

SEQ ID NO: 34624 - DNA, 156 bp, Homo sapiens
gtctatatgtagtatttaaaatctttgctgtcaaaaaatacattatgtcaaaattaaaattgataaggggtaattaaaaatagattgtggataaagaatttatgatgaggaaactataatcatagcattctcacaacctatcggatgggtaaaagt

SEQ ID NO: 34625 - DNA, 372 bp, Homo sapiens
  misc_feature 3, 68, 88, 91, 98: n = A,T,C or G
gtntatattttgaccaccgcagccaatgcacagagacaggatattgccttcgcctaccagtagaaggnccaaaaaggaacttgcatcngcnctgaagncagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatggtacaagactgatctggagaaggacattattttcggacacatctggtgacttccgcaagctgatggttgccctggcaaagggtagaaga

SEQ ID NO: 34626 - DNA, 182 bp, Homo sapiens
gagtcagtgtggaagagaggtgagggtgtgctttactttttgataaagagaaagatgtttactcataaacccttcaaaaggtattaacaaaatgtttaccaaacctattgctttattttaaaaacataatttgtgttttctatttgtaagatctgacatttcgaggcaataaaaacttctta

SEQ ID NO: 34627 - DNA, 321 bp, Homo sapiens
  misc_feature 33: n = A,T,C or G
gaaggcatattctcctcccaccttgtacctcanccgcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttgga

SEQ ID NO: 34628 - DNA, 120 bp, Homo sapiens
ctgcctgtgtgggagggtggttactgtgggtggaatagtggaggccttcaactgattagacaaggcccgcccacatcttggagggcatctgccttactgattaaaatgtcaatgtaatct

SEQ ID NO: 34629 - DNA, 326 bp, Homo sapiens
cggaagaaattcaaaagaaaagaacccgccgagtcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataact

SEQ ID NO: 34630 - DNA, 226 bp, Homo sapiens
ctgcccagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgc

SEQ ID NO: 34631 - DNA, 362 bp, Homo sapiens
ctgggacagaatgaagacaagctaagcttcatcttctgctactatcacaaactgagatgacacttctatttttttttatcttgaagggtagtccactatatttggaaagagcataggcttatgttacaactgggattcaaaaatgggccttctccatcttctttgctaccgttagagtcttacgtacatctttttcctaggcaacaacagctttcaaaatggtattcacatttccatctttgtttttttacacactccttccctatagcctgttctctacagtgcagctgaagaaccctttttaaaaatgttttcagtgacatattcaggatatagaataaaatccagaatttttaaactat

SEQ ID NO: 34632 - DNA, 343 bp, Homo sapiens
gagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagaacaacatagtaaaagagtagcggtcattttaaatgaatctggggaaggaagtgcgctggagaaatccttagctgtcagccaaggtggagagctctatgaagagtggctggaacttaga

SEQ ID NO: 34633 - DNA, 114 bp, Homo sapiens
gggtgacggggaatcagggttcgattccggtatagggagcctgagaaacggctaccacatccaaggaaggcagcaggcgcgcaaattacccactcccgacccggggaggtagtg

SEQ ID NO: 34634 - DNA, 258 bp, Homo sapiens
  misc_feature 24: n = A,T,C or G
aggatagagaaaatattacagagnaaaatcacacatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatga

SEQ ID NO: 34635 - DNA, 374 bp, Homo sapiens
  misc_feature 33, 166, 185, 200, 227, 260, 290, 296, 311, 347, 368, 369: n = A,T,C or G
aaggccaagatccaagtataagggaaggcatcnctcctgaccagcagaggctgatctttgctggaaaacagctggaagatgggcgcaccctgtctgactacaacatccagaaagagtccaccctgcacctggtgctccgtctcagaggtgggatgcaaatcttcgngaagacactcactggcaanaccatcacccttgangtggagcccagtgacaccatcgagaangtcaaagcaaagatccaagacaaggaaggcatncctcctgaccagcagaggttgatctttgcnggaaancagctggaagatggncgcaccctgtctgactacaacatccagaaagagtcnaccctgcacctggtgctccgnntcaga

SEQ ID NO: 34636 - DNA, 356 bp, Homo sapiens
  misc_feature 85, 127, 211, 214: n = A,T,C or G
gctttttaacttttgtgtatatgtagggtagattttttttttaagtgaaagcaagcttattaagaaagtaaaagaataaaaaggnggcttctccataggcagaaaactagcgtagtttttttattanaaattgttattcaacaatagtacatgttacaaataaataccattttaaactgaaaaaattgtagactttcaaatcagttagggnggncaccctaaaaaagggcattttttccccttagtctccttgttcatgttgctcacaacaagaaatgggctaatgctatgaataataataacaaacactgccttctgtcaggccctgtgctgaataccgtctgcatatgtatagg

SEQ ID NO: 34637 - DNA, 274 bp, Homo sapiens
cgcggtggctcacgcctgtaattccagcactttgggaggccgaggcgggcggatcacgaggtcaggagatcgagaccatcctggctaacatggcgaaacgccgtctctaccaaaaatacaaaaaattagctgggcgcggtggcaggcgcctgtagtcccagctactcaggaggctgaggcaggagaatggtgtgaacctgggaggcggagcttgcagtgagccaagatcgcgccactgcactccagcctgggcgacagagcgaaactctgtctc

SEQ ID NO: 34638 - DNA, 133 bp, Homo sapiens
gtttctttttctgttttgagtgtctttctttgcaggtttctgtagccggaagatctccgttccgctcccagcggctccagtgtaaattccccttccccctggggaaatgcactaccttgttttggggggttta

SEQ ID NO: 34639 - DNA, 262 bp, Homo sapiens
aactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaaga

SEQ ID NO: 34640 - DNA, 422 bp, Homo sapiens
gcaaacaatatgaataattaaaatagtaagtggaaagaaaaaagaaaacctatttgagtcaaacatatttgaatttcttttttattcagacctattaccaaaactaacctgggtgcatttaacagtttgaagtttccacattttctttagcccattagaggaagcactaatgagatacgaagtaattagaagataaaaagcagtatcatttcgtcagcaaggccatccctgctaacgaggctaacaaggctaaatgaaagcatttagcttttttaaataagtgcttatttatgactgtattttaaaacaaagagaagctatctcgaaagttattaaataagcattatatcaccctgtcttactcagtgtataaaattagcactatagttaaaagaaggtaaaatagatcttgattccaaaga

SEQ ID NO: 34641 - DNA, 421 bp, Homo sapiens
  misc_feature 420: n = A,T,C or G
atcatgacccttggcctaatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcana

SEQ ID NO: 34642 - DNA, 280 bp, Homo sapiens
atcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttggggtaacatctctggttgtaccaaagaagaaataaatatggtttcttaatctct

SEQ ID NO: 34643 - DNA, 278 bp, Homo sapiens
gttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgactgcgacgcccaatgtaagaagtatgacaagtgctgtcccgattatgagagtttct

SEQ ID NO: 34644 - DNA, 340 bp, Homo sapiens
gtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgct

SEQ ID NO: 34645 - DNA, 280 bp, Homo sapiens
ctgagataagaacctttgtgtaacaccaacacttaacttcagaaagacatgcattatgtggtgtaatcaaacccgatgctttcagatgacctacttacatcttcaatgtggataagataaggaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacga

SEQ ID NO: 34646 - DNA, 238 bp, Homo sapiens
gggtcacatctcatcaacagtggttgaaatttgaggatccagcctgtgggatatgatcaaaagtcatctgagtgtgatgagacattcagctctaacatctctaaccctggcagctccaactctttccaggacaccaacaaactccccaggtgtagcagatgccacgtggtcaacacagcctcttaaagtccttccagtggaatgttgctaggttctggctgcttatgaactgattaga

SEQ ID NO: 34647 - DNA, 384 bp, Homo sapiens
  misc_feature 5: n = A,T,C or G
gaacntatggccttttaatgagagacagattaataattgcagatatgaataataaagcagaaagattggctgtgccatcttttattctaataaggaattagatttggttactgaaggagcagctgtttgccaggtatggtatgctactgtttgagatagacactttgatgcaaaatgggacgcttgatggtgatggacttgaaaaaaatggatatgcgatgtgtgtttaaatttctcaagccctataacaataaacattttacaccccaatgattattattctataccaattgtcattcaaaaacctacaaaaaagacacagtgacaatgttttctgtccttgttgttctttgagagaaaagacctatgatggtacctcagtgc

SEQ ID NO: 34648 - DNA, 301 bp, Homo sapiens
gatctcatctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggaagggga

SEQ ID NO: 34649 - DNA, 238 bp, Homo sapiens
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccaga

SEQ ID NO: 34650 - DNA, 422 bp, Homo sapiens
ggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagcaaacctgaaaatacactatcctccagctatcagaattatattgagatctactcacatttatgaatgatgttcagaga

SEQ ID NO: 34651 - DNA, 390 bp, Homo sapiens
  misc_feature 3, 16, 24: n = A,T,C or G
gantgaagccccaaangttcgaangtgttgcagcttcttcgccttcgtcaaatcttcaatggaaccctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaaagaccacccattttgtag

SEQ ID NO: 34652 - DNA, 162 bp, Homo sapiens
cgactcttagcggtggatcactcggctcgtgcgtcgatgaaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 34653 - DNA, 433 bp, Homo sapiens
  misc_feature 5, 15: n = A,T,C or G
atgtnaagttttatngaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataattttttgttctttgaaaaaaaagccctaaatcatagtaaaacattat

SEQ ID NO: 34654 - DNA, 335 bp, Homo sapiens
  misc_feature 17, 22, 35, 54, 77: n = A,T,C or G
cccgggaatctcggccntttantggcccgggaacntgtaccaagccgttaatcnccccccctagggcatgattaacnaaagcaaccctttcccttcccccgagtgattttgcgaaaccccccttttcccttcagcttgcttagatgttccaaatttagaaagcttaaggcggcctacagaaaaaggaaaaaaggccacaaaagttccctctcactttcagtaaaaataaataaaacagctgcagcaaacaaataaaatgaaataaaagaaacaaatgaaataaatattgtgttgtgcagcattaaaaaaaatcaaaataaaaattaaatgtgaac

SEQ ID NO: 34655 - DNA, 433 bp, Homo sapiens
  misc_feature 15: n = A,T,C or G
gggccttccggggancgttgtctgcaggcacctcagaatggtccagcgtttgacatacccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaagacgc

SEQ ID NO: 34656 - DNA, 430 bp, Homo sapiens
  misc_feature 3, 11: n = A,T,C or G
aancatttacnccaaataaagtataggcgatagaaattgaaacctggcgcaatagatatagtaccgcaagggaaagatgaaaaattataaccaagcataatatagcaaggactaacccctataccttctgcataatggattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagc

SEQ ID NO: 34657 - DNA, 214 bp, Homo sapiens
  misc_feature 2, 6, 11, 21, 30, 32, 45, 46, 47, 50, 66, 75, 81, 85, 91,93, 148: n = A,T,C or G
cncccntgaanctccagggangtttgagancnagctttgggcccnnncantgggtgaaaactccantcttttacnaaaaantacnaaaaantntagtggggggtgtgggtacctgggccgccctgtaatccccagcctgcctcaggangcctgaggcagaggttgcagtgagcccaagatcgtgccactgactccagccccgggtgacagagct

SEQ ID NO: 34658 - DNA, 201 bp, Homo sapiens
gcttgacaagttcttgaagactttaaatagcaagcaagggagaaatggttttctgtagtatatagagttagaacttgcagtgccaaaatggaattggcgaatggaaacatctgaatgactttctagaaatattttctaatggagtcatagttagggcagtagatttggttatctagggggaagtagctagagcagtttttg

SEQ ID NO: 34659 - DNA, 435 bp, Homo sapiens
  misc_feature 8, 15, 45: n = A,T,C or G
ccgggaantcggccnttatggcccggggaggcattgaggcagccngcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatggagcttcttcatggagtaaaaatgtatttaaaagaaaattgagagaaaggactacagagccccgaattaataccaatagaagggcaatgcttttagattaaaatgaaggtgacttaaacagcttaaagtttagttta

SEQ ID NO: 34660 - DNA, 339 bp, Homo sapiens
tatggccggggaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagag

SEQ ID NO: 34661 - DNA, 139 bp, Homo sapiens
  misc_feature 139: n = A,T,C or G
gtattgaaaacacttagtatgcagttgataagaggaatttggtataattatggtgggtgattattttttatactgtatgtgccaaagctttactactgtggaaagacaactgttttaataaaagatttacattccacan

SEQ ID NO: 34662 - DNA, 260 bp, Homo sapiens
gattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtcc

SEQ ID NO: 34663 - DNA, 396 bp, Homo sapiens
tcctgtgaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctgg

SEQ ID NO: 34664 - DNA, 338 bp, Homo sapiens
  misc_feature 9, 19, 27, 71: n = A,T,C or G
gagccttanatgcctaccntctagtantgagtaaccaccttgaaaaccatttccctttcaaagtgcaagangttgcaaaagagacttgtcatgaagtcttttggccctggcttaaatggtgagctgaatgctggataatctctgctggctccttaatcagatttaaaattctcagtgtttcctaattgtttctgcatactttacctgagttgtagctgtattattacactttatttgctatttttgtctttcttgacttttggtagttctagcatttagaaaccttttatttatgattcaacacatagttatattttagtagttatcatttgatatat

SEQ ID NO: 34665 - DNA, 225 bp, Homo sapiens
  misc_feature 17: n = A,T,C or G
caccctcgacctccaangtgctgggattacaggcgtgaaccacagcgcccggccagccaattactttttttaatgtggggaaaggtatataatcttgctgaaagagttttgctccatgtgatggttcatgcctgtaatcccagtattttgggaggctgaggcaggaggatggcttgagcccgggagtttgagaccagcctgggaaacagagacccctgtctctac

SEQ ID NO: 34666 - DNA, 405 bp, Homo sapiens
aatggagcagtcagtacccacacaacatttattcattaaattcaacatcttacataggtgcagttcctgatgctccaaaacaattacaatggtaatatcaaagatcactgatcacagatcaccataacagatatattaattattcaaatgttgtgaaaattaccaaaatgtgacacagatacatgaagcatacacatgctttgtaaaaatggaaccaacagacttgctggactcaggaatgccacaaaccttcaatttgtaaaaacaaacaacaaaaaacccccacaatatctgcaaagcacaatgaagcaaagtgcaataaaatgaggtgtgcttgtagctattgtagtcaaatccttagagatagaaagttgcgtgggtggttgctgggcctgggggaggaga

SEQ ID NO: 34667 - DNA, 301 bp, Homo sapiens
agcaaaagcaatcttgagtaaagggaagaaaactagaggcctcacactaattcccaaatatactacagagctgtagtaaccaaaacagcattgtactgacataaaaacctgcacatagaccaatgaaatggaatagataactcagaaataaattcacacatttacagccaacttacttttgacacaggtgccaacaatatacattggggaaaagacaggttttttttaataaatggtgctgggaaaactgtatctccatatgcagactaatgaaactagacccctgtctctcaccatatgc

SEQ ID NO: 34668 - DNA, 222 bp, Homo sapiens
ggcttctttattttttaaatgaggggcagacacaaagtaaatttccaagtcaccttgaaatcaggcactttgaagcctagctatgagtaaactcagttatactgtctaatacccattttagcttttctgtttacagcataaactttaaggccggtcttagttcttttaagaagtcaaaagcagaacctctctagcagaagtgtttttcaaacattaaatcct

SEQ ID NO: 34669 - DNA, 346 bp, Homo sapiens
  misc_feature 1: n = A,T,C or G
naggaatgttaagtgccttttttctcagtttgcttttgtttattctggacatagttttgtttcatgatgtaataaaaatagtgagcctgaaccagacaccaccatggctttctgagagctccagtctcatgggagaggcagacagataagcacaggatcatggtgcagtgagtatggccactgctcagcgtccaggagacccgtggctagttgtggtgcctaggggagggatgttgtattagtcagttctcacactgctataaagaactaccagctaggtgcggtggctcacacctgtaatcccaacactttgggaggccgaggcgggtggatcatgaggtcaaga

SEQ ID NO: 34670 - DNA, 280 bp, Homo sapiens
  misc_feature 132, 155: n = A,T,C or G
gggtggaagttctccaaaacaatatccacaacaaagtctgacctcactctgagggagatgcgaagtgggaggaagaaggactaaccagctccctggagtaagaggaatttgctttccctgtctgcccaccangggctatatgtgccacctttcangttggggccaaggaagtgatgtcagtgtgacagaagggagagttagacctccagacgtcagcctccctcccatggggtacattttcaatctgagtgttgttgccttagctgtgttggtattggct

SEQ ID NO: 34671 - DNA, 404 bp, Homo sapiens
gacccagtgagtgtgagcatttaagaagcatcctctgccaagaccaaaaggaaagaagaaaaagggccaaaagccaaaatgaaactgatggtacctgttttcaccattgggctagctttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccat

SEQ ID NO: 34672 - DNA, 435 bp, Homo sapiens
atttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacgtccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcaga

SEQ ID NO: 34673 - DNA, 275 bp, Homo sapiens
acccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacaccc

SEQ ID NO: 34674 - DNA, 481 bp, Homo sapiens
  misc_feature 12, 18, 27, 32: n = A,T,C or G
tatggccgggcnaagaangcccctcanttttntaaccctggcaaaatcttgttaatgtccttgctaaaaaataaataaaagctagatactggaaaccctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttctttttaatttccaggaaaaaataaaaagagtatgagtcttctgtaattcattggagcagttagctcatttgagaataaagtcaaatgccaaacactagctctgtattaatccccatcattactggtaaagcctcatttgaatgtgtgaattcaatacaggcta

SEQ ID NO: 34675 - DNA, 417 bp, Homo sapiens
  misc_feature 57, 155, 270: n = A,T,C or G
ggggcaacgggtttgccgccagaacacaggtgtcgtgaaaactacccctaaaagccnaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaagggctccttcaagtatgcctgggtcttggataaactgaaagctgagcgtgaacgtggtntcaccattgatatctccttgtggaaatttgagaccagcaagtactatgtgactatcattgatgccccaggacacagagactttatcaaaaacatgattacagggacatctcaggctgactgtgctgtcctgattgttgctgctggtg

SEQ ID NO: 34676 - DNA, 167 bp, Homo sapiens
ggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 34677 - DNA, 100 bp, Homo sapiens
cagtggtgtctgattgatacatagatgatgatcttagcttcttctgtgtctcttgaagtgccaacaagaggaataactgaataaattggttgctgttact

SEQ ID NO: 34678 - DNA, 132 bp, Homo sapiens
aataaattattttttagatcttgaaatttataataaaaatactttacctaccctgatcaccaaaacctgatgttttaaatgtgctttctttttgaaatttatgttttcaaataaaatctccctaaagcaata

SEQ ID NO: 34679 - DNA, 133 bp, Homo sapiens
ggaaaaggaacagattgttcctaaaccgaagaggaggttgcccagaagaaaaagatatcccagaagaaactgaagaaacaaaaacttatggcacgggagtaaattcagcattaaaataaatgtaattaaaagg

SEQ ID NO: 34680 - DNA, 166 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgataaag

SEQ ID NO: 34681 - DNA, 354 bp, Homo sapiens
  misc_feature 1, 116: n = A,T,C or G
naggagatgaaaggagaaaaacgtcagatgcctgtctgaattacagtcatagttggggctagtggcacatcagccagaaatttaacagagaaattgtgaagaggagaaagtcttanaagaactagacaatgtctctatacatgcctggctgcctgggaaactatgcacatgtctgaaactgaaagcatacttaaaatctggctaaactatgaacgtgctccaacccatgcaaaattggtcagcagtacgtagaagctttattggctcaaggtatttgagtacaacctctgcccaaattatggactgaccaagtgaaccatgcaaacacagggataacccctaggaagccaagct

SEQ ID NO: 34682 - DNA, 326 bp, Homo sapiens
  misc_feature 12: n = A,T,C or G
gtttaacaaggnacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatat

SEQ ID NO: 34683 - DNA, 393 bp, Homo sapiens
agtgcagaaagtttttttcttcctctttatggagatttgagccattgggcttagattctgccaactaaatgattttattcctacctaaatagttcctattgttcagcaacaatagtcctcctcatctttgtgtcttccatggtacctacagaagttctgaatatgtggcaacgatttttttcttaatagagacaggggtcttaccagcctggcccgcatggcaaaacctcatctctacaaaaaaataaaaaattagccaggcatggtgggacacgcctgctgtactcccagctatgaggtaggaggatcacttgagctcaggagggcaaggcttcagtgagctgagatcatgccactgcactccagccggggcaacaaagggagaccctgtgt

SEQ ID NO: 34684 - DNA, 327 bp, Homo sapiens
ggaggtcgcagcttccactggcgcgggttgagttccctgttgcccttggtctcggggtcgctgtaggcgctgaggctgcagctatcgtggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaat

SEQ ID NO: 34685 - DNA, 143 bp, Homo sapiens
atctgaaaccagcttctgggtttcctgaggcacggcaggaatgtttccctctgcaaaccctgcttctaggtgatggagctttgccacattttctctttcagttgtgggatagccacatctctttgttagttggttttatctgg

SEQ ID NO: 34686 - DNA, 388 bp, Homo sapiens
  misc_feature 6, 10: n = A,T,C or G
atgacncagnagacgtggacatgcggaacgtccctgtgaaaataaattgctataagcatttaaagcagcagaagtgagcagcagaagtaggaagactgaggaagtttctatcatgggaaacaaacttctcagagaagttcttgctccatcacacaagatggggggcactgactttgtgtaagctcagcaggtaaggtgtgggcatggccaggagcaggaagggcacctgaaagaaaaaaagaaagaaagaaagaaagaaagaaagaaagaaagaaagaaagaaagaaagaaagaaagaagaaagaagaaaggaagaaagaaaggaaggaagggagagaaagaaaagaaagaaggaagaaaagaaagaaagagaaaggaagaaaggaag

SEQ ID NO: 34687 - DNA, 285 bp, Homo sapiens
  misc_feature 280, 283: n = A,T,C or G
gtttcataaactgacagggaaaacctagcaagaatttttaatgcctagataatttatggaaaagtataacttgttttttcttaggtattttctttaagcactttattgaatgttttttatgaagaaatctttaattaaatcactggctcgctagcttttcccatcaaatctaaatcttctgttaaaaatatataataaactcagacatagaatatgtggtgtggtatttggaatgtcatcttcacttatttttatgagaattttttttttttttagtttnaangc

SEQ ID NO: 34688 - DNA, 101 bp, Homo sapiens
ctcggaacgccgccaggtacgtgcgttttccttgtttcccgcgctcccagagcgcactctcggtagggaacgaataaaatcccggctggtgtgtaagagcc

SEQ ID NO: 34689 - DNA, 340 bp, Homo sapiens
  misc_feature 4, 12: n = A,T,C or G
agtntttagatncaaaattaagaaatatttacttttcctagaaatattaaatggttataaaaattataacacccctatgttcctaaatggtgctttattaaaaatgtagatatacattcttttctgttttcagtctgcatttgaagtgtttgacaccgtcaggtgttctggatttaaatgataaaaagcattatccaaaaggaattagtgaccctgaacttaaaaacatctaatagtctctctccctttttctttttactagacgtgtgcctatagtttgttcatatgaaatagtctttatgcttcagatgcaaagtgtaatgtacataacagtatatac

SEQ ID NO: 34690 - DNA, 468 bp, Homo sapiens
gaaaggtactgaaaaatcttcaattggactatgttgacctctatcttattcattttccagtgtctgtaaagccaggtgaggaagtgatcccaaaagatgaaaatggaaaaatactatttgacacagtggatctctgtgccacgtgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattg

SEQ ID NO: 34691 - DNA, 419 bp, Homo sapiens
  misc_feature 11: n = A,T,C or G
gactcttcagnattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccact

SEQ ID NO: 34692 - DNA, 218 bp, Homo sapiens
  misc_feature 145, 195, 199: n = A,T,C or G
attgtagaaaactgcagaaaacatgaataaaataaaaagcacttgtaagaccacttcctagaaataaccactgttaacatttgggcatatttcttcttttttttttaaccccaacaatgactacatagggcatatttctttatgngcacacactctctctctctctctctctctctattttctaaaaatagcagngatntttgtctgagttcaggctg

SEQ ID NO: 34693 - DNA, 327 bp, Homo sapiens
ggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtattag

SEQ ID NO: 34694 - DNA, 341 bp, Homo sapiens
ccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggatc

SEQ ID NO: 34695 - DNA, 393 bp, Homo sapiens
  misc_feature 11: n = A,T,C or G
gcattattacngtgacttggggaggagataggccccaaagcccatagacattgttaataggttagggacaggctcagtgcttatggcaccatgtcctgtagttgtcacaccatcctggactgctgcaaggcccttctgtggccctggcatgtcctggaaaagtcaccacaaattccaatatggagagatagccactgttaaaatgttagcttgtctgcttcctgtcttttttctgggcattatgtttttactcagttgaagctatattgtatatataattacgtgtgtatgtatgtgtgtatttcaatttgtagtgtcatgagcatttctaggcatcattagaaattctaaacaataccacgctgtaccatcatttactaagcagcctagtga

SEQ ID NO: 34696 - DNA, 378 bp, Homo sapiens
gatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcgcaagtttgaaatttcctttgtcatctggtgcatagtaagtattttcctttttttttaaatttaattacttatttgtagatcaataaacacatgttccggattcatttatgtaactgttaactgttcaaagtcaacagctacatagacactcttttgttt

SEQ ID NO: 34697 - DNA, 424 bp, Homo sapiens
  misc_feature 17: n = A,T,C or G
gtggataagacttcagnaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaagggaggatgtggttaaccctgtttcacctggtttgtcctaaggccatagttaaaaagtaccagctctggctggggtccgtgaagcccaggccaggcagccaaatcttgcctgtgctgggcat

SEQ ID NO: 34698 - DNA, 302 bp, Homo sapiens
atctatccccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattga

SEQ ID NO: 34699 - DNA, 168 bp, Homo sapiens
ctggggctgcgtgggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgc

SEQ ID NO: 34700 - DNA, 321 bp, Homo sapiens
  misc_feature 16: n = A,T,C or G
aggaaaacaaacgagnaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaagaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatg

SEQ ID NO: 34701 - DNA, 406 bp, Homo sapiens
acctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattataga

SEQ ID NO: 34702 - DNA, 275 bp, Homo sapiens
atatgatatttgctaagctgccaaacatgtttatttagcagatactgtatggaattttctgaacacctctttaacgtatgaggaaggttgtcctgctacggatgcaattcaattcttcctttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttgg

SEQ ID NO: 34703 - DNA, 128 bp, Homo sapiens
gaatatttagtagaaatgatgcttctgctcggaatggcccacaaatctgtaatttgaaatttagcaggaaatgacctttaatgacactacattttcaggaactgaaatcattaaaattttatttgaat

SEQ ID NO: 34704 - DNA, 472 bp, Homo sapiens
ggctagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaactaaccaggag

SEQ ID NO: 34705 - DNA, 370 bp, Homo sapiens
caggagacctaggggccaagcgatatgaaatcccctgagactcagtttttccatctttcagatgggactgtgtgaggaacgagcagaacagtctgtatatggaagcactttgtaaagccttcagttctgtaggtaattgccactcttcttctctctagcagtctaaggtcctgtgctctctggtaggggtgcttcaatactttttttgtcttaaagtcacttccctccagcttctggtaatgttgtattgcttcttaattctagtcatttagaagttgataaataacaactgcttcttgttctaagcaaattacatgtcatttgatcagaactttatgaggaaggaggcttagaggggccacacagctac

SEQ ID NO: 34706 - DNA, 423 bp, Homo sapiens
  misc_feature 7, 18, 26: n = A,T,C or G
agtgatncaaaattaacnaagaaganctgacttgtttaccaacgggataatacaacaaaggaaatgaacaaatttgagctacatagataataatactcacagatgtgaaaggaattatcaagatggaaaaatacatttagaatgatcttttacataaagtttggaaaaaaatttttaatacattgtaatttgttacattggtgatgaaactctacagtgaaatatatgaatgatcatcataacaattgggataatcaggagggaggaaataaaagggaaataccaacaagaagacgtatattgggagtatcttggattgctggcaaattctattttctgaccaaggtttggtaacatcaatgttaatgttataaattttttcttactgtttttaggttttattactctctgtatgttatattc

SEQ ID NO: 34707 - DNA, 419 bp, Homo sapiens
  misc_feature 25, 26: n = A,T,C or G
gggctgttcagaagccttagaggtnnttttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtagccattttgtcagatccatgtattttggagcataaaatgtatgctgttgtgaccaataaatataaaatatggtaattgggaattaactccacaccatagtatgcattgttatacatactgtgtacctaattatgtttagc

SEQ ID NO: 34708 - DNA, 309 bp, Homo sapiens
agagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccccagcttttcttgcaaccagagtatttttgtacagatttgctttctcttac

SEQ ID NO: 34709 - DNA, 202 bp, Homo sapiens
  misc_feature 5, 44, 97: n = A,T,C or G
aatcngacaaattcctaggaactgcggatattgctcgccacagnatcttatcagttaattgcactcttagatgtgctaagagtcagcttgcacaagntaagtccttgaggaaggggctgccagtgaaaaagccaagataaagtctgtctagctctcttagctaaaagaaagtcaattcaggtagaaacaaggctaagtgatt

SEQ ID NO: 34710 - DNA, 500 bp, Homo sapiens
  misc_feature 13, 14, 32: n = A,T,C or G
tcctgaagctgannagcattcgggcccgagangtctcgcctccgtggcccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatattgatatgcttatacacttacactttatgcac

SEQ ID NO: 34711 - DNA, 265 bp, Homo sapiens
agaaactcttgggttttgttattagaaatcttttttttccagtattatgaaggattcctttttgcagaagtacaaaggaaagaaaaatcctcaaagatttagtagactctagcatctgatttaattttactcttaaaaatctcgaggctgggcatggtggctcatacctgtaatgccagcactttgggaggctgaggcagaaggatcgcctaagcccaggagttcaagaccagcctgggcaacagtgagaccctgtgtctacatt

SEQ ID NO: 34712 - DNA, 126 bp, Homo sapiens
cacctggaaagcatttgtttctactttgatatgactgtttttcggacagtttatttgttgagagtgtgaccaaaagttacatgtttgcacctttctagttgaaaataaagtgtatattttttctag

SEQ ID NO: 34713 - DNA, 471 bp, Homo sapiens
gggctggatttgaagtattttgatgttgtgttttgcaaatattgaagttacaataatggcaacagaagaggaacagatacacagctttacacttagcagaatgttacatttaaaatctgacaaggcgccaagatggtgactgtctcctctaaaccacgaaagagtaagatttgtgcaaccctcctcctcttccacctccttcaggagaattaaatgaatcaagactttggaaagacggggaagagccgggacttggcagtacttgaaacaggaggaatacaccagcctaaatgtacagactttgtagccgagcccactcgatcggtctgtgccttcacgtgaccaccatctgtgcctccctcgctccatccaaatttgtgtaggctgctccttggagctatgcctaaaatatagctacaccagagccctggaaactgtagtcaagtaacaggcctcactgttttttttctt

SEQ ID NO: 34714 - DNA, 205 bp, Homo sapiens
  misc_feature 8, 9, 24, 27, 29, 30, 41: n = A,T,C or G
ccgggaanngttgatgaccaaccnagnanncctaggagtantgggtaggccctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacattc

SEQ ID NO: 34715 - DNA, 270 bp, Homo sapiens
  misc_feature 6, 70: n = A,T,C or G
tcggcntttatggcccgggggattctcatggaaacatccacaagctgaaggcagacaaggcccgcaagangctcctggctgaccaggctgaggccccgcaggtctaagaccaaggaagcaccgccaagccgcccgtgaagagcgccctccaggcccaagaaggaggagatcatcaagactttatccaaggaggaagagaccaagaaataaaacctcccactttgtctgtacatactggcctctgtgattacatagatcagccattaaaat

SEQ ID NO: 34716 - DNA, 442 bp, Homo sapiens
  misc_feature 13, 16, 33, 46, 47, 78, 82, 83, 121: n = A,T,C or G
tggcccgggaacntcnaactgcccatcctgganttttgggggggannctttaaaaaacctgacctctgaatgtattantganncaagtgatagccaagatattttgaagaaaaatagatantagggacctgctctataagcccatcataatttattatgaagttataacaagtaaaacagtaaggtatttggcatggaatagagaacccagaaacagacccaatgcatgggtacaggatataacacagggaaatgagggacaatatatggttctgggataattatttatatggggaaaataaagaaattggatccctacctcacacatacaaaaaaaatcataattgaattaaaaacttgcatgtgaaaggaaagactttaaaacatttagaaaaagtattggaggctatgatcttggggtaggaaagcatttctttttttt

SEQ ID NO: 34717 - DNA, 462 bp, Homo sapiens
  misc_feature 2, 17, 25, 27, 41, 42, 47: n = A,T,C or G
cnggggggccccgagcncccgcagnancgcgccgggaagannaagcnccggaaggtggtggcccgtcgctgcccaggcaccaagtgtcccgcccgcatctccttcagcgcgagcccactgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatttgggatgtgccatactttgcagatgtggtgagcacgactgaaaatgtagctgtttatatctgggacaacctccagaaagttcttcctgtaggagttctttataaaggtaaaagtatacgaaactgacaataat

SEQ ID NO: 34718 - DNA, 232 bp, Homo sapiens
  misc_feature 2, 87: n = A,T,C or G
tnttggcccgggaactgccagttgcttacctaaaggttttaacccgcaccatgcaccaccaccacacgcctttcttatgcaatctantgtttgcaccttgtgcctttcagttagccttctgtaggaagtagaagtcatatgttgtctttgttgtagtgaaattatacagatagagttccatatattgtatttgtttcaatggtaaatccttttggaacatatagaatgcaga

SEQ ID NO: 34719 - DNA, 277 bp, Homo sapiens
cgcggtggctcatgccctgtaatctcagcactttgggaggctgaggcgggtggatcacaaggtcaggagatcgagaccatcctagctaacatggtgaaaccctatctctactaaaaaatacaaaaaattagccgggcttggtggcgggcgcccctagtcccagctactcgggaggctgaggcagcagaatggcatgaacccaggaggcagagcttgcagtgaactgaaattgagccactgcactccagcctgcgctacagagtgagactccgtctac

SEQ ID NO: 34720 - DNA, 468 bp, Homo sapiens
gaggaaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgaagaagttaaatggcacagatcctgaagatgtcatcagaaacgcctttgcttgctttgatgaagaagcaacaggca

SEQ ID NO: 34721 - DNA, 499 bp, Homo sapiens
  misc_feature 7: n = A,T,C or G
tcggccntttatggcccggggatctctctcgggtggagtcttctgacagctggtgcgccctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcaagaaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactga

SEQ ID NO: 34722 - DNA, 185 bp, Homo sapiens
  misc_feature 24: n = A,T,C or G
tatggccgggagggccttagaaanggaatgaagctggtaatgtttaaaaaaaattatactgagaatgcaaaatcatttttgaaattctggtcaaattaataagatagatatcttccctccattacttcaatgtaccatatttttgtttgtttgtttgtatgtatctgtgtgcctctctgtttgcc

SEQ ID NO: 34723 - DNA, 246 bp, Homo sapiens
  misc_feature 5, 92, 94, 133, 179, 214, 224: n = A,T,C or G
ggccnaaaaaaatgctgaatttttgctgcacatgcttaaaaacgcagagagtaatgctgaacttaagggtttagatgtagattctctggtcntngagcatatccaagtgaacaaagcacctaagatgcgccgncggacctacagagctcatgggcggattaacccatacatgagctctncctgccacattagagatgatccttacggaaaaggnacagattgtncctaaaccagaagaggaggttg

SEQ ID NO: 34724 - DNA, 276 bp, Homo sapiens
  misc_feature 4, 5, 274: n = A,T,C or G
aaannaactgaattatgtgggaatcagtttattaattgtaaaaaataattataataaaattagctgatgtagttttttaaaagttaaacgagttttttgaatagcttcactcatttctagcatgtaagtggtaatccattatggtgttgggcttttttgtttgtttgtttgtttgttttgagacagggtttgtctctgtcacccaagctggaggttgcggtgagctgagatcgcgccgttgcactgcagcctgggaaacgagcgaaaccccgtntc

SEQ ID NO: 34725 - DNA, 379 bp, Homo sapiens
  misc_feature 6, 7, 35: n = A,T,C or G
tcggcnntttattggccgggggtggtatgaaaacnttcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacat

SEQ ID NO: 34726 - DNA, 226 bp, Homo sapiens
actccccaaccccccactcctacttcctgaagggccctcccaaggctacatccccaccccacagttctccctgagagagatcaacctccctgagatcaaccaaggcagatgtgacagcaagggccacggacccctgctccttcggaggacgtgccctcacccctcactggtccactggcttgagactcaccccgtctgcccagtaaaagcctttctgcagcagctg

SEQ ID NO: 34727 - DNA, 325 bp, Homo sapiens
  misc_feature 5, 20, 27, 38, 45, 55, 65, 66, 89, 143, 154, 184, 201, 233: n = A,T,C or G
gattncatggataaatatgntacaggnaagtgaacagntctaggnctaagggctngaagactatnnccaagtgatagacgtggggcttnaggcattatcaatcggacaaattcctaggaactgcggatattgctcgccacagnatcttatcagntaattgcactcttagatgtgctaagagtcngcttgcacaagttaagnccttgaggaaggggctgccagtgaaaaagccnagataaagtctgtctagctctcttagctaaaagaaagtcaattcaggtagaaacaaggctaagtgattaaaagaaaaggaaagtctaagaac

SEQ ID NO: 34728 - DNA, 447 bp, Homo sapiens
agatatttattgagctcctaggtgtcaggcactgttctagtaagagacaaaacaaaatccctgctccagtgaaacttatgttcttgttttaagcttttatttgttcattattttatgtttttaagtttatttggtctgttactttttaaagtctcttttaaacaattgtatatgctagctagaccaataaatattaaacaattccactatactgtagctgccttatcccttagagatagaaggaaaaaaataagaaactaatattgccaggacacagtggttcacgcctgtaattccagcattttgggaagccaaggtgggaggattgcttgggtctaggagttcaagaccagcctgggcaacacagtaagaccctgtctctacaaaaagtaaaattagacaggtgtgggtgatgtgcaccttgtggtcccagctactcaagaggcc

SEQ ID NO: 34729 - DNA, 440 bp, Homo sapiens
agatgaaacctgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtaag

SEQ ID NO: 34730 - DNA, 404 bp, Homo sapiens
  misc_feature 19, 21, 31, 44, 45, 48, 49, 77, 103, 115, 163, 234, 248, 272: n = A,T,C or G
tgggcggggtatataactngnaaaaaacagnattatagaattannccnntgacacttgctaatggacatctggcatntcatctcctttttcctcctaagtgtntgtatgtgtttnaagatttctgtttttacgattaaaactggaaacatgaggttttttgcntttgttttttttacataattacatatattccttctgaatcatttatcttttgagaaagaaatgttacctanacttcaaatgtgcnttttgtttgtgaggtaattaaatntgcttctacagtggaggcttacaaaattattgtgacaactattttgaagctgaaaggatagtttttctattgctaagtcatttgaaaaagtgaccattttgccagtgaaatgaagtggaagttagtaggaga

SEQ ID NO: 34731 - DNA, 435 bp, Homo sapiens
  misc_feature 11: n = A,T,C or G
aggagaacagnataaatgtggtctcagccgccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgaga

SEQ ID NO: 34732 - DNA, 299 bp, Homo sapiens
atagcatctttctatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 34733 - DNA, 177 bp, Homo sapiens
atagtgggaagatttataggtagaggcgacaaacctaccgagcctggtgatagctggttgtccaagatagaatcttagttcaactttaaatttgcccacagaaccctctaaatcccttgtaaatttaactgttagtccaaagaggaacagctctttggacactaggaaaaaaccttg

SEQ ID NO: 34734 - DNA, 335 bp, Homo sapiens
  misc_feature 2, 4, 17: n = A,T,C or G
ancnacctaccattatntgactgtgtggttctagtttaaggatagacacatagatcaatggagtagaattgagagtgcagaagtaaactcactatggttaactaattttcaacagtgatgccaagacaatggtgaaagaatagtctttttgacaaatggtgctaggacaactagataccacatgcaaaagaatgaagttggacccctacctcaaaaaaaatatataaattaattaaaatgtatcaaaaacttaacaacaaaactataaaacttttaggagaaaacatacatataaatctttgtataatcttatattaggtttttaagacttaaca

SEQ ID NO: 34735 - DNA, 196 bp, Homo sapiens
  misc_feature 10, 11, 37, 38: n = A,T,C or G
cccggggaanntcggccctctatggcccgggaggaannaataaaaatattggaaaactatgcatatacaaaatttaaagttcaatcaataaataaaaatttggagagaaaagaaacaaaatggtggaaatagaaagctccactgattacagccctccccctcaccccaagaacatcaagttaccaattatctacac

SEQ ID NO: 34736 - DNA, 479 bp, Homo sapiens
gctctaggaaggaaatacctaggtccaggagaattccttaaaaccattacagaagacttagcatcaactttgcacagttattttcagaaaataattgagaatggtacactacccaactcattttatgaggtcaagaatatctttatctcagtaccagaaaaaagtacaataaaagaaaactgcagcccagttggtatcagcagtatataaagaagagtaatacatcacaacccagtacaggttattccaggtgtgtaaatgtggttcagcattctaaaatcaagcagtgtaatctacgctatcaacagaataaagaaaaatcacacaatcagttgttgcaggaagaccatttgacttaacccaacactcattcatgataaaaactctgagcaggttggattagaggggacagtaacactatcttgtttaaaaagaatctataaaatacttaatgggggtaagactgaatgcctcctctc

SEQ ID NO: 34737 - DNA, 473 bp, Homo sapiens
  misc_feature 2, 13, 28, 38: n = A,T,C or G
tncccccgggaanctcggccatttattngccgggaaanaaattgcccggcgcccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaatctgtcaattccagtatccccaaagcctgttgtgtgcccactgaactgagtgccatctccatgctgtacctggatgagtatgataaaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggact

SEQ ID NO: 34738 - DNA, 368 bp, Homo sapiens
gcacattagacatcagagttaagatatgaattggcagtcgcatttaggagagaattctgggttggggatgtatgtttggaatccccagtgtatagataatagttaaagccatgaggtgagctcactttttaggcagtggttacagagaagagaagaggtccatgaattaaactctggaacataccgctatttagagaacaagcaggtgaagaggtatcataagagttgctggtgaggtaagccagagggcctgctgtcctaggagacaagtgaagagactgttccctctctcctttcctcccttcctccctaactcccttttttgggactgggtcttgctctgttgctcaggttggaatgcagtggtg

SEQ ID NO: 34739 - DNA, 447 bp, Homo sapiens
  misc_feature 5, 6: n = A,T,C or G
agagnnacaggagcccgacctggtgagacaggagcctggagccacctgcctgcttttgtgaggccccagactccactgctatcatcaggtgaagctctgttgcctgcacacaaaagcttttctgcatttacaaagagagaagggcctgagtttctggtgcaatgcgtcaagctgacatatggactttattacagggaagtggttaccaggtgggtccctatttagtggctgttattgtgaattttattgttcggaaattcactttagcatttatttcagatcctaaatagcaccggagtgatacaatggctaatcaaacaaagagggctgtggggagcagacagtcagcatccccctctgtgatttcaggccctggtttgattagtagccataaaattttttacgtgtggcactttgagcaaaggtgcaggaaatttgtggtcagga

SEQ ID NO: 34740 - DNA, 472 bp, Homo sapiens
  misc_feature 55: n = A,T,C or G
atataagcaaatgtgcatttgtgctgattttgagaaggttttctctattggaccngtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaat

SEQ ID NO: 34741 - DNA, 447 bp, Homo sapiens
ggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggat

SEQ ID NO: 34742 - DNA, 312 bp, Homo sapiens
aagctttctaatggtgtcttcgaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgt

SEQ ID NO: 34743 - DNA, 471 bp, Homo sapiens
  misc_feature 6, 85, 115, 156, 173, 206, 249, 285: n = A,T,C or G
attgtnaatttgagaaaaaggacatatgagtttttgcatttattaatgaaacttcctttgaaaaactgctttgaattatgatctntgatgtcattgtccattttactaccaaatnttaactaaggccttattaatttttatataaattatagtctngtcctattaaatctagntacaatttattgtcatgcataagagctaatgtngttttgcaaatgccatatattcaaaaaagctcaaagataattntctttactattatgttcaaataatattcaatatgcntattatctttaaaaagttaaatgtttttttaatcttcaagaaatcatgctacacttaacttctcctagaagctaatctataccataatattttcatattcacaagatattaaattgccaattttcaaattattggagtaaaagaacaaaatgattctctcccaaagaaagacacattttaaatact

SEQ ID NO: 34744 - DNA, 383 bp, Homo sapiens
aacctccgcatagttttattttcctttgaaacttcatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttc

SEQ ID NO: 34745 - DNA, 471 bp, Homo sapiens
gactcctggcctctggtgatccttgtgcctcagcctcccaaagtgtcgggattataggtgtgaactactgtaactggcctagttgttgcttttggataaagagacaaaactttttaaccactttaaaagagagtattaagtttagatagctaaaatttattaacttagttttacattttatttaatttacattacttattattttttttcattttttgagacaggatcttgctctttcactcaggatggagtgcaatttgtgcagtcacaactcatggcagcctcaacctcccaggccgaagcacgcctctcacctcagcctcccaagtagctgggaccacaggcacacaccaccatgcctggctaattttttaatttattttttgtagagacagagtctcactgcgttgcctaggctgctcttgaactcctgggctcaagtgatccacctgctttggcctcccaaagtgt

SEQ ID NO: 34746 - DNA, 159 bp, Homo sapiens
  misc_feature 11, 15, 22, 26, 45, 48, 53, 59, 90: n = A,T,C or G
atcttatcagntaantgcactnttanatgtgctaagagtcaactngcncaagntaagtncttgaggaaggggctgccagtgaaaaagccnagataaagtctgtctagctctcttagctaaaagaaagtcaattcaggtagaaacaaggctaagtgatta

SEQ ID NO: 34747 - DNA, 210 bp, Homo sapiens
  misc_feature 56, 86, 98: n = A,T,C or G
caatcggacaaattcctaggaactgcggatattgctcgccacagcatcttatcagntaattgcactcttagatgtgctaagagtcngcttgcacaagntaagtccttgaggaaggggctgccagtgaaaaagccaagataaagtctgtctagctctcttagctaaaagaaagtcaattcaggtagaaacaaggctaagtgattaaaagaa

SEQ ID NO: 34748 - DNA, 375 bp, Homo sapiens
  misc_feature 318: n = A,T,C or G
ggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtnggaagtcaccattgcagatgcttaagtcaactattttaataaattgatgaccagttg

SEQ ID NO: 34749 - DNA, 404 bp, Homo sapiens
  misc_feature 2, 3, 5, 10: n = A,T,C or G
anncnagtcnagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtaagtagtgatacctatatttccacattgtgcattgtgacacacttgtctagggatgcctggaagtgtataaaattggactgcatttcttaga

SEQ ID NO: 34750 - DNA, 318 bp, Homo sapiens
  misc_feature 11, 16, 186, 253: n = A,T,C or G
taaatgtgganagganagggaggatgaattacccaggattcatggagccgggatcagattacccaggaacataggagtggattcctgccccaaccaaacccgcattcgtgtggatttttttattcaacttaattggctattccaaagattttttttttcctatttttgacgattggagcccttaanatgcacgatggaattgtgttttgcgttttttggtaaaaggagcaaagcgaggacctggagataaacnctggagcaatctccttggaaggattcagcacgagtagatggtaaacatttaaaggggaaaggggg

SEQ ID NO: 34751 - DNA, 381 bp, Homo sapiens
cgggccttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatggggttgccacccacaaccattgctttagcacttttacttcaaatcaatgaaggattgattaaaagtt

SEQ ID NO: 34752 - DNA, 469 bp, Homo sapiens
  misc_feature 26: n = A,T,C or G
ggaggagagaagtgctacattaaagncgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgt

SEQ ID NO: 34753 - DNA, 459 bp, Homo sapiens
  misc_feature 21: n = A,T,C or G
ggcaggggagataccatgatnacgaaggtggttttcccagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaatttagaagataaaaacatacttttagaagaaaaaagataaatttaaacctgaaaagtaggaagcagaagaaaaaagacaagctaggaaacaaaaagct

SEQ ID NO: 34754 - DNA, 361 bp, Homo sapiens
gtagtctacaggccctactgtgtcagggagcttcaatctaagacaagctaacagttattttcatcttatgctgagaagaaattattgtagacaaaggtttcattttatctacattttaatgttaaaacgtgtctataagtgttcttaactggataggtgcagggaaccaaagcagaaaggtacctgggttttcagttagagaagtagtaccagatagaactttttattgcatgcccgagagccatgtgtgataaagatggaacatagggatggtaataatttggtgttcaagtcgatttacctgtggttttgcctggagaaaacaagcctgaaggctgtgggacctccatatttttgttat

SEQ ID NO: 34755 - DNA, 364 bp, Homo sapiens
  misc_feature 13: n = A,T,C or G
ctaaatgtgagantccttttttgtattggtttgaatgttttgatttaagagtatgggatgagggaattttaggttcattgtgttcacatcagtaggacttaaacctatggaagactttgcagcagaataggaagattattctcccagcctacccaacagttgaaaaacgatcagaaggacttggaagggagcaatggaggattgatgacgatggcaaagactgagcagtccccaggcgtgacaacaaaaaggaaagcaatcagctgtggagagagaaatgggtgtttgatgatattattgaaagtcgggatataaacaagaatgagaaagggaggaatggggaaactgaatgagacagaagcgc

SEQ ID NO: 34756 - DNA, 287 bp, Homo sapiens
atctcagacgctcaggaaatagaaaccgtctgaactatcctgcccgccatcatcctagtcctcatcgccctcccatccctacgcatcctttacataacagacgaggtcaacgatccctcccctaccatcaaatcaattggccaccaatggtactgaacctacgagtgcaccgactacggcggactaatcttcaactcctacatacttcccccattattcctagaaccaggcgacccgcgactccttgacgttgacaatcgagtagtactcccgattgaagcccccat

SEQ ID NO: 34757 - DNA, 307 bp, Homo sapiens
aattaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtcgc

SEQ ID NO: 34758 - DNA, 390 bp, Homo sapiens
ctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtg

SEQ ID NO: 34759 - DNA, 476 bp, Homo sapiens
aggaacaaccggtaccagctgctgcaaaatctgccaaaatgtaaagaccgtcgagactaggaagaaactgcatcaactaacgagcaaaatcaccagctaacatcataatgacaggatcaaattcacacgtaacaatattaactttaaatgtaagtggactaaattctgcaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaagggatcaattcaacaagaggagctaactatcctaaatatatatgcacccaatacaggagcacccag

SEQ ID NO: 34760 - DNA, 287 bp, Homo sapiens
gaggcattgaggcagccgcgcaggggtttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaga

SEQ ID NO: 34761 - DNA, 340 bp, Homo sapiens
ggaaacagaaggaaaagtccttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagtttgaagttacttcatggatgtcatacccatgaagtgcatttggatgagatagaagaaattg

SEQ ID NO: 34762 - DNA, 153 bp, Homo sapiens
gattccatacttgctaaataacctgataataacctggttttccatgtaactgcctctaggaagaaaatgtactgttcatgctgacacagatatttcagtctgcatggtaaaagttctaaatcttactacaaaataataaactggctggtttag

SEQ ID NO: 34763 - DNA, 471 bp, Homo sapiens
gtgtgttttgttttggaatgatatggaagttggaggcatctcaatctttcatttgtaaatacttcagcatttgtctaacaatgacattcccaacatagcccagtagcataatttcatctaagaaaataaacataaattcgatatatgtaacatctagtgcatagtcagctttccccaagatctagttgtggtttgtgcattgcatttagttttaatcttactattcataacacctcaaaactgaaaactacccaaatgaacaacagtcaaattaataagtaggttgcagtctatctgtatttgtatatctatctatatatacatacacacacacacatacatatactcagtggaatactgtataccaatgaaaaagaataaactacagcttcacaccatgatataggtgaacgtcacaaacatgatattgagttagaagaagccagaaacaatgtgtgagacaattacctg

SEQ ID NO: 34764 - DNA, 473 bp, Homo sapiens
  misc_feature 42: n = A,T,C or G
ggaataaactgtaatattagaaattatgctgctaattatatnagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccatatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaaataagtg

SEQ ID NO: 34765 - DNA, 496 bp, Homo sapiens
  misc_feature 14, 458: n = A,T,C or G
attggcccgggaancgtatttcttgagaataaataaaatgtactctagagtaatggaatcgtgatgtccaatacagaggcagagtccgggtccagctcaaacaggaagatgggagcctctgccttgtacagttcccatcactgtatcacatcttcaggataggtgataacagtgtgaagggtgtgctcattttcttcagctgtgagtagaggagtcttcccgagagtagcagttgttgatccaaatgattgaagccttcaggttaagaatgtctggaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggagggaggnaagaggacacttttatttgaagaacaacaactagaaga

SEQ ID NO: 34766 - DNA, 229 bp, Homo sapiens
  misc_feature 10: n = A,T,C or G
tgagcagatnataaaattgatatacttctagccggataaccaaaagagagaagacacaaattactaataatagaaatgaaagaaactctaagctcacaaatttgataactgaaatgaactagatcaattccttgaaagacaaactaccaaaactcacacaagcagaaatagaaaacctgaaaagccctttatctgttagagatattgaaccaataattaacaactttcc

SEQ ID NO: 34767 - DNA, 472 bp, Homo sapiens
  misc_feature 39, 76: n = A,T,C or G
agacattgaatatattaaattattccatattttcttttngtgaaaaattttttaaatggaagactgttctaaaatnacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattataggttaatgtcttaatccagcttgcaagtgaatggaaaaaaaataagcttcaaacta

SEQ ID NO: 34768 - DNA, 469 bp, Homo sapiens
  misc_feature 271, 343, 392, 417, 449, 465: n = A,T,C or G
gtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgngttttgaatctctccagagttgcatgtagatagcatttatttctgtgcccttaaaccctttagaaatacctncaaggaaaaatgtagaggaatagaatgtattttttcatgacattttganccaaatttcatcatttaatgatcancaatttcttgcattaatttgaattaagccttnattcaaaaagaggggngcct

SEQ ID NO: 34769 - DNA, 164 bp, Homo sapiens
atagacacggttcactaaattgatttagtcagaattcctagactgaagaacctaaacaaaaaaatattttaaagatataaatatatgctgtatatgttatgtaatttattttaggctataatacatttcctattttcgcattttcaataaaatgtctctaatcc

SEQ ID NO: 34770 - DNA, 482 bp, Homo sapiens
ggtaggagcctctctccctactgctgctacacaagaaccctgagactgacctgcaggacgaaaccatgaagagcctgatccttcttgccatcctggccgccttagcggtagtaactttgtgttatgaatcacatgaaagcatgaaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgctt

SEQ ID NO: 34771 - DNA, 104 bp, Homo sapiens
cgggtccaaagggacagaatggccctcggggtgaaattggtctgccaggacctcagggtccacctggacctcaaggaccaagtggtctgtccattcaaggaatg

SEQ ID NO: 34772 - DNA, 120 bp, Homo sapiens
  misc_feature 2: n = A,T,C or G
tnagtaatgacattttgtcatgtcaaactgtgaacataaatttgtactgtacagtcctcatatactatatacagtatgcaatatatattatatacttgttaataaaaccatcagaatatt

SEQ ID NO: 34773 - DNA, 472 bp, Homo sapiens
ggggttttctgtggttttttatgaggaactataagttaccaaaagttgaatgttgtcatttatttgtgctcagtaatgattttcatttctttgttatcagagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcgtaagtagtataatacctggcataaacagctaaaagaagagaaggatgggcatgaaagctggagtggtcaaaggaaagcctggtggaaaagacaggatctttgtatttagaaggctcgagaagggcctttccaggcacaggggaatgctgtgagcactagtacagaggaaggaatagagtaagtagtgcctctt

SEQ ID NO: 34774 - DNA, 381 bp, Homo sapiens
gggcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatcccacaggctgagaactcgttcacctccaagcatttcatgaaaaagctgcttcttattaatcatacaaactctcaccatgatgtgaagagtttcacaaatccttc

SEQ ID NO: 34775 - DNA, 361 bp, Homo sapiens
aagtgaaggctgagtaggaattggagaaaggcatgtgttggaggaagagcaggcacctagagaatggtccatctaggtggggcaccgtggctcacgtatgtaatcccagcacttcaggaggccaagaagggtggatcacttgaggtcaggagttcaagaccagcctggccaatatggtgaaaccctgtctctactaaaaaaaatacaaaaattagctggaccaggtggcatgcacctgtaatcccagctactcaggaagctgaggcaggagaattgcttaaacccaggaggcagagattgcagggaactgagatcacgccactgccctccaacctgtgtgacagagaaagaccctgtctca

SEQ ID NO: 34776 - DNA, 245 bp, Homo sapiens
  misc_feature 6, 13, 99, 102: n = A,T,C or G
cgtgcnaggtganctgaggatgcccgtgcgccgcttacctgacaccggaagccccatgaccacctaaggaccctgctgaaaaagttccagacccaagangancagggctgagccagcgagcagacagtgaacgtgttggcccagatcctcaagcgacccaaccccgagcgcaagatgatcaacgacaaaatgcacttctccctcaaggagtgagggcttggtccaatacatggctctgccccccc

SEQ ID NO: 34777 - DNA, 174 bp, Homo sapiens
  misc_feature 8: n = A,T,C or G
ctttaatnagagaacttcaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgcg

SEQ ID NO: 34778 - DNA, 108 bp, Homo sapiens
gacgagttagtgggtgcagcgcaccagcatggcacatgtatacatatgtaactaacctgcacattgtgcacatgtaccctaaaacttaaagtataataataataaaca

SEQ ID NO: 34779 - DNA, 253 bp, Homo sapiens
  misc_feature 6: n = A,T,C or G
agaganggggtttctccttgttgtacaggctgatctcgaactcctggcctcatgcgatctgcctgcctcagcactttgggaggccaaggcaggcggatcacttaaggtcagaagttcgagagcagcctgcccaatgtggtgaaaccccatctctactaaaaatacaaaaattagctgggtgtggtggtgcacgcctgtaatcccagctactcaggaggctgaggcaagagaattgcctgaaccgggaggtgga

SEQ ID NO: 34780 - DNA, 317 bp, Homo sapiens
  misc_feature 26: n = A,T,C or G
gtaatagaattgtttacctttatacnaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggaggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctg

SEQ ID NO: 34781 - DNA, 370 bp, Homo sapiens
  misc_feature 22: n = A,T,C or G
gctttctggtctcggccgcagnaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaac

SEQ ID NO: 34782 - DNA, 226 bp, Homo sapiens
  misc_feature 15, 38, 71: n = A,T,C or G
ccgggaattcggccnttatggcccgggcagcttggccnaaatggtgaaaccccacctccactaaaaatacnaaaattagctgggcattggtggcaagtgcctgtgattccaacctactcaggaggctgaggcagaattgcttgaaccctgggaggcagaggtggcagtgagctgagatcttgccactgccctccagccctgggcgacagagtgagactccatctcg

SEQ ID NO: 34783 - DNA, 113 bp, Homo sapiens
cacagtggctcatgcctgtaaccccaacactttgggaggtcaaggcaggtggatcacttgaggtcaggagttcaagaccagcctggccaacgtgttgaaaccccgactctact

SEQ ID NO: 34784 - DNA, 430 bp, Homo sapiens
cagacagttgtactttttgataacttagggaaaacagaaatgacttgaacaagggattgcctgcctcactgcattgcagagatacaatttctgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtc

SEQ ID NO: 34785 - DNA, 472 bp, Homo sapiens
ggctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcac

SEQ ID NO: 34786 - DNA, 382 bp, Homo sapiens
gggaggcgaagaacgcaaagctgagaacatggacgttaatatcgccccactccgcgcctgggacgatttcttcccgggttccgatcgctttgcccggccggacttcagggacatttccgaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggagga

SEQ ID NO: 34787 - DNA, 248 bp, Homo sapiens
agttacatatttaccgaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatc

SEQ ID NO: 34788 - DNA, 464 bp, Homo sapiens
  misc_feature 16, 455: n = A,T,C or G
aacatgattacagggnacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatgggaaagtcacccgtaaggatggcaatgccagtggaaccacgctgcttgaggctctggactgcatcctaccaccaactcgtccaactgacaagcccttgcgcctgcctctccangatgtctac

SEQ ID NO: 34789 - DNA, 333 bp, Homo sapiens
gaagggcatcagtggcagccatggtagagtgagaggaggtgtttcctaagagactaaatgaggatgtgtgagagaaaactcggccctaatatgggctggctagatagtaaccttaaggaacatgttacaagagaatgatgtaagatggtaacagcataatgggtttcaggggttgtggtaaaggtaatagatctaccacagcacgtggttcacagcactcaacctgtgtaggttgacacaagcgggacaaggcagccatgcccctccctaacagggctggctgtggctgatggcaatcagcttttggtcttgatagtttgacttgctggggga

SEQ ID NO: 34790 - DNA, 321 bp, Homo sapiens
  misc_feature 19, 102: n = A,T,C or G
tcccccgggaattcggccnttatggcccggggcccgcccgctgtggctctaaggcctaccaccttcagaagtcgacctgtggcaaatgtggctaccctgccnagcgcaagagaaaagtataactggagtgccaaggctaaaagacgaaataccaccggaactggtcgaatgaggcaccctaaaaattgaataccgcagattcaggcatggattccgtgaaggaacaacacctaaacccaagagggcagctgttgcagcatccagttcatcttaagaatgtcaacgattagtcatgcaataaatgttctggttttaaaaaac

SEQ ID NO: 34791 - DNA, 473 bp, Homo sapiens
aactacaatcttccctgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgat

SEQ ID NO: 34792 - DNA, 371 bp, Homo sapiens
  misc_feature 25: n = A,T,C or G
gggcatgtcattgattacaactagnaattgcagattgtgcacattaaacacatcagcttaaaaatccttgacattttaaaaatacctttggcagagttttagagtagtcatgatatttaaaatattatcctaatttgttggtttcctagagtatattttcatttaatcatatgtatgataagaacatacagacttcttgctgggggcattggctcatgcctgtaaagcctgtaatctccgctactcaggaggctgagttgggaggattgcttgaggccaggactttgagattggtctgggcaacatagcaagactctgtctctgaaataataataataataaaaatactaagtatatttcttggtttctag

SEQ ID NO: 34793 - DNA, 460 bp, Homo sapiens
ggagctgagatttaaacttaggtctcaggcaggtgcagtggctcacatgtgtaatcccagcattttggaaggccaaggcgggcagatcagctgaggtcaggagtttgagaccagcctggccaacatggcaaaacgctgactttaccaaaaatacaaaaattaggcaggcgtggtggcacacggccatattcccagctacttgggaggctgaggcacaagaatctcttgaacctgggaggtggaggttgcagtgagccaagatttcgcaccactgcactccagcctgggtgacacagcgagactgtctcaaaataaaattaaagaaataaataggctgggcattggtggctcacgcctgtagtcctagcactttgggaggccaagacaggcggattgcctgagctcaggagttggaggccatcctgggcggcatggtgaaaccccgtctctactaaaatat

SEQ ID NO: 34794 - DNA, 472 bp, Homo sapiens
ggagttggacagaaacaatcttgagctgtctctcttgttcaagaatataaaaaaacagtagctcaaatgtagtatcattattaacggaatcttatttaaagaatgatatgtcattactatctctatttgaaaatggcttggcctgaaagccaaagccattataattacattaatgtttaaaaaaagtgataattgccataataggtatgaattatttctatatttcaaagatagattaatgctagacatatcaaaatatgttaactacactgagaggtcaagatgaaatacggacattccaatgaatgaattgtcataaaggcaaggttcagcatccgttcttgatttaaaaaaattcttagtaaaaagacaagaacttttaaaagtttgacataacatatctgaactcaactaccgttaatattcttaatggtaaaatattttcaggcatcccctagcaaaataattgttt

SEQ ID NO: 34795 - DNA, 281 bp, Homo sapiens
gtgtgtgctgtctttgaaagtctgcttgaacaggcatcacttgcatttgtgctgattgctttaagatgtaagatgtgctacattatttttaagaaaaaaaatagttattgataaaacttttaattttaacctactgcaggaaaacatgagaaaatccacagcatgctgataacaattctgaatgatgctactatgctctttatattccagaatcaccactggtaccatgttctgatcatttcaacagtctctaacttgttagttaccctttagttcattct

SEQ ID NO: 34796 - DNA, 297 bp, Homo sapiens
  misc_feature 9, 15, 18, 20: n = A,T,C or G
cgctcagantaaccngancnccacagagtgagggggaatcctaggggaaaaaaagagagagctaaataagagaaacaccaaattctttgtgtatattctacaaagtctctggaccctgagtcatgcatgtaggggcagattgaaagtgtctaaactgagatccgagctaccgtccaccgtagatatcaacatttaaacattcaaagaagaagtaatgaaatcttacagaaaatctttccgaaatttgaagacgaaatgcttcccaacatgttttatagccagcatgacattaatacc

SEQ ID NO: 34797 - DNA, 310 bp, Homo sapiens
  misc_feature 2, 18: n = A,T,C or G
tncccgggaattcggccntttattggcccgggtgtggtggttcatgccctgtaatcccagcactttaggaggccgaggcaggtggatcatgaagtcaggagatcaagaccatcctggttaacatggtgaaactccatctctactaaaaatacaaaaaaagttagctgggagtggtggtggatgccctgtagtcccagctacttgagaggctaacgcaggagaacagcttgaacctgggaggcagtgcttgcagtgagctgagatcgcaccaccacactccaagcctgggcaacagagcaagactctgtct

SEQ ID NO: 34798 - DNA, 472 bp, Homo sapiens
agggagtgccagttaacactggaaggattaaggcaggtcccttctcttgagactcccctctgagatctgaaaaatgatgtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttat

SEQ ID NO: 34799 - DNA, 140 bp, Homo sapiens
  misc_feature 1, 6, 44, 56: n = A,T,C or G
ncgggnaattcggccattatggcccggggctttcagcgccctgnaggttccgggangtcagctcccagcccgaggacgtcggatgtcatcgtccttgctgctttgccaccccattcccgtcaataaagtggtttgaaccc

SEQ ID NO: 34800 - DNA, 400 bp, Homo sapiens
aggctttcagtctctcaggctactggctaaaatgtcactactgatataatgcagcacccaggcatgagaaattggttcggtctgggaggataggccatgttactacctcaggacccattccctgggtttgttttacaaggttactggatccaaattagaaagagatacagatgggtttttgtgttgccagacgcagtagagcttaacttgtgaatataccaagatttaaaaccacaaaaggaaataaaaccccttagatgtgaggttggaattcattacaggtctgacttcgcttgattaatacagatccttatgagaaattagactgttttaagggaatcccattgtttttttctcattaatacagatttgatgtgaaacagtttcttttgtggaatat

SEQ ID NO: 34801 - DNA, 431 bp, Homo sapiens
gaacactaaaatgaaatatggaagaaatggattctgagtgttaaatgtgagaaacaaggtttatactgaacattctaagccattgccaaatgtcaactttaaacttcagatcaagagattcagaattctacagtgtcaggtatggtagatgttctcacaccaaggtgaacacaagaatcaaccgagtgatttatttaaaagagagtcctgagtgccacccccagaaattcagatttttaaatttttaaataaatctgagtgtgtcttttaaacttacattttgtaccagcaactccaagttattctaatataggtaatccacagataaaaaatatttgttagaacgtattttttaaaaatattgtttagaccataaatattttagccttttcttttttttaacaaaatacaaatttatactttttagacag

SEQ ID NO: 34802 - DNA, 476 bp, Homo sapiens
ggctggagtgcagtggctcgatctcggctcactgcaacctccgcctcccgagttcaagcgattctcttgcctcggcctcccgagcagctgggactacaggcttgtgccaccacgcccggctaatttttgtatttttagtacagaaggggtttcaccatgttggccaggattgtctcaatctcttgacctcgtgatccgctggttttcaaaaaccaatttggtagatgaaaaatctatcccattgattgaatgctgctttgtctgtcagtgaagttagatatcttattagtttattttgttaatgagactttttaattattctttcatgccctccttcggttcatgtttacacctgtaactactgcagtcccattatttttcttgatggaataggagaactcagcccagattcttatccacccagactatctctaggagaactacttggtgtcagccttgcaaataccattctcaga

SEQ ID NO: 34803 - DNA, 472 bp, Homo sapiens
ggctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcggccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacatt

SEQ ID NO: 34804 - DNA, 230 bp, Homo sapiens
acatattttgaagttaacttataatagtataaatggttatgtcatgaggataatggaaatagagctatgtaacaaatgactgtcaaactgtcagattagattatttttagaatgggaacttgggtcttgggatagttttagtgaaagtacacatggattttaaagttctgtgcctgaatagtttagatgaaagatgatatggttttgaaaatgtgttgcattaagtggct

SEQ ID NO: 34805 - DNA, 458 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagtttaaaagttgtaggtgattaaaataatttggaaggcgatcttttaaaaaga

SEQ ID NO: 34806 - DNA, 352 bp, Homo sapiens
cggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagattttt

SEQ ID NO: 34807 - DNA, 362 bp, Homo sapiens
gctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggtttc

SEQ ID NO: 34808 - DNA, 472 bp, Homo sapiens
  misc_feature 401, 409, 433: n = A,T,C or G
agcaaccctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttgcaaaaaatgatgagagaattcttccacatgtacttctgtgcttagaacatttttacggacctaagcgctggagacgttgctgcatgtcggctgggttttttttttcatacncccgagcncggaaaaactaacgcaaaattgtnttttcttacctaggggaaatctgaaatgactgcaaattc

SEQ ID NO: 34809 - DNA, 299 bp, Homo sapiens
  misc_feature 125, 168, 184, 269: n = A,T,C or G
ggttctagcgcagttttttttttcttgtctataaagcatttaacccccctgtacacaactcactccttttaaagaaaaaaattgaaatgtaaggctgtgtaagatttgtttttaaactgtacagngtctttttttgtatagttaacacactaccgaatgtgtctttanatagccctgtcctggnggtattttcaatagccactaaccttgtctggtacagtatgggggttgtaaattggcatggaaatttaaagcaggttcttgttggngcacagcacaaattagttatatatggggat

SEQ ID NO: 34810 - DNA, 473 bp, Homo sapiens
  misc_feature 109, 117, 134, 256: n = A,T,C or G
ctggctgatgtccaacctaatgaaggcgtaacacacgttcacttaggatctggccatatggcaattcgctttaaacaatagggttcagggaagaaatatattgtatgtntaaaagtngggactgcttatttctnaggattcctcataaactgtgggctatagatcttaaaaggcagggatcgaggaaggataatgtcaagttctgccataacacaaacctctataagagatatctcagaattccagtctatccagnggcctacttatttcacacagttccaattttacagaagaatatagctactcttttggagtaaaagtaaaaatctttgatttgcctttccaccagtccagtatccagaatgttatatattaataattaggggaattctgttgcagagatagggagaaaggaagaggacctgctttagagtcagaatgataatttcaagaaaaactttgtcagaagacgt

SEQ ID NO: 34811 - DNA, 307 bp, Homo sapiens
caaatgacttgaaagagtggtcaataaattgattccagacagcattggaaaagacatagaaaaggcttgccaatctatttatcctctccatgatgtcttcgttagaaaagtaaaaatgctgaagaagcctaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgac

SEQ ID NO: 34812 - DNA, 226 bp, Homo sapiens
ggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaacattg

SEQ ID NO: 34813 - DNA, 472 bp, Homo sapiens
caggctggagtgctgtggcatcttagctcacagcagcctcgacctaccgggctcaagcgatccttctgcctcagtctcctgagtaggtaggactataggcatgcaccaccatgcccagctgtttttaaaatttcctgtagagatggggtctcagtgcattggccagactgacctgaactcctggctacaggtgatcctcttgccgaggtgggtgggtcatctggggtcaggagttcgggcccagcctggctgacatgacgaaacgccatctctactaaaaacacaaaaattagccaggtgtggtggcatgtgcctgtagtcttagctactcgggaggctgaggcaggagaatggcttgagcccgggaggcaaggggttgcggtcagctgagactgcgccagtgtactccagcctgagagacagagcgagactctgtctcaaagaaaaacaaaaaccaaaaccaaccaaaatc

SEQ ID NO: 34814 - DNA, 257 bp, Homo sapiens
tacagtgactcatgcctgtaatcccagcactttgggaagccaaggcaggtggatcacgaggtcaggagattgagaccatcctagccaacacagcgaaaccccgtctctactaaaaatacaaaaaattagccgggtgtgggggcacattgcctgtaatcccagctactcgggaggctgaggcaccgagaatcactggaactcgggaggcggaggttgcaagcactccagcctgggcaacagagtaagaatccatctct

SEQ ID NO: 34815 - DNA, 112 bp, Homo sapiens
  misc_feature 112: n = A,T,C or G
tgataagaggaatttggtataattatggtgggtgattattttttatactgtatgtgccaaagctttactactgtggaaagacagctgttttaataaaagatttacattccan

SEQ ID NO: 34816 - DNA, 393 bp, Homo sapiens
  misc_feature 43: n = A,T,C or G
aacatatagacatgtaatatatttgacagggaaagcacaaagnaagatgggtgggagcaaagctgaattgcagtaagtacataacaccagatggtatgtcaaatccacaggaacaaaataataaaaccagaaatgggaaataagatggttaatataataagccatataaatatattcttgtcctttcggtttctttaatagacataaattatataaggtaataattatagcaatcttttgttgggttttgagtgtgtgcatatgtctgtatacatatatgtgcatatacatatatatatctgtgtgtgattgtgtatacttatgcataagtatacacatgcatatgtagtatgtgtagtaatggcacaaaaagagagaagagagaatagaact

SEQ ID NO: 34817 - DNA, 311 bp, Homo sapiens
atgtgcatgcatacattttgtatgtttaaagtttatgtaggacggtgcggtggctcacacctgtaatccccctactttgtttgggaggctgaggcaggagaatggtttgagcccaggagtttgagaccaacttgggcaacatcgggagcctctggttctacagaaaaataaaaaaattagctcgggggtggtggcacatgcttgtagtcccacctattcaggaggccgatgtgggagggtcacttgagcccaggaggtcaaggctgcactttagtcttggcgactgagtgagatcctgtcttttaaaaaga

SEQ ID NO: 34818 - DNA, 468 bp, Homo sapiens
gctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtatggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaacca

SEQ ID NO: 34819 - DNA, 298 bp, Homo sapiens
gggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggct

SEQ ID NO: 34820 - DNA, 476 bp, Homo sapiens
  misc_feature 454: n = A,T,C or G
cagtgggaatacccgtatttgctgagcattttgccctctctcttgggccttctctcctttccccgcaacaacattagctacctggtgctctccatgatcagcatgggactcttttccatcgctccactcatttatggcagcatgggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccangccaaagttctggaaagctcct

SEQ ID NO: 34821 - DNA, 391 bp, Homo sapiens
  misc_feature 12, 26, 290: n = A,T,C or G
atcaccctcgangttgaaccctcggntacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaagggaggaagaagtcttacaccactcccaagaagaataagcacaagagaaagaaggttaagcctggctgtcctgaaatattataagggngggatgaagaatggcaaaattagtcgccttcgtcgagagtgcccttctgatgaatgtggtgctggggtgtttatggcaagtcactttgacagacattattg

SEQ ID NO: 34822 - DNA, 470 bp, Homo sapiens
  misc_feature 7: n = A,T,C or G
accgganacaggtgcagtccctcacctgtgaagtggatgcccttaaaggaaccaatgggtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaagcttctcagcatcacgatgaccttgaataaaaattgcacacactcagtgcagca

SEQ ID NO: 34823 - DNA, 432 bp, Homo sapiens
  misc_feature 2, 431: n = A,T,C or G
tnaaaaaataaataaaataaaacagtaaattcaatggaggcaaaacaaattagagtaaaaaaagctactgtgttttcactaataggatattattgtcactttttggagatgaattcagtaatgtggttggtgaggaaaacgagatataggaggccatattcgaagatgtcaaaaaatcttgagggttcaaggacacaaacaaggaagagttgagttttcatagatggaagtagccagtggagagaaaaagagatgggagatgtaagaaagaaaagagaaaatgaatggaatcaggccctagaggaatcagaacagaatcaaaacatgaatagccaggatatcatttttcatgattcattacttgtgtcaaattttcagtattgataattgctatgaagcaaataaaacaatgctgtagagttgcttactant

SEQ ID NO: 34824 - DNA, 179 bp, Homo sapiens
atacacacacatgcacacacatacatgcacacacatgcacatggacacacatacatgcacacacatacatgcaggtgtgcagacttggctccaggcgtgtgtttgatagtattattctatgatatttccctcatctccatagaataccagcttctgaatcctcaatcagcctttactgc

SEQ ID NO: 34825 - DNA, 224 bp, Homo sapiens
agaagtggacagagtaatgctttttgtttttgtctgtctggacagtagttggctgtaacaaagtttgtgtctaactaaaaagtacctgttgactcagatagccacagtaagagactagaacgtgatggcataatggtgacaaaaatgagttcaaatctacagtccaccacttcctagttggctcaccacttattacctacacttaatttttgctacctaatctg

SEQ ID NO: 34826 - DNA, 387 bp, Homo sapiens
cggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgcggattgtgtcctatgcgctcatga

SEQ ID NO: 34827 - DNA, 242 bp, Homo sapiens
  misc_feature 4: n = A,T,C or G
aatnaagtgagaggattgacttcgcagaaaccaatacttactataaacgtatggtcattaaaacactgaactactgaccaagaataagtatatataccaatggagtagaatagggaggccagaaaattacccatgtattatgtatatgcatacatggtttatttcaaagatggcactgcagagctatgagaaaaatggtttttttccaataagtaatttggggtcaattggatagccttact

SEQ ID NO: 34828 - DNA, 331 bp, Homo sapiens
  misc_feature 28, 36, 40, 51, 52, 55, 78: n = A,T,C or G
attcttttaaataatcttaaatgtaatnaattaggntcgnctttggctttnnggnggattagactacgctctatgtgngaccattcactataagaaaacacagttcttttcctgagacagcatatggggaaatttggagtagcaggcagtactttctagaatggaatttacaagtgggataatctgagaacagcacatgtcagtatgtaggtgctttccatagctatttgattaagcttgtccaatcccagcttacctctggctactgctgtagttcctccgtattcatgagcatcaaatgtatctaatttattttaaaattgtaaagaat

SEQ ID NO: 34829 - DNA, 315 bp, Homo sapiens
  misc_feature 282, 294, 296: n = A,T,C or G
ggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctnaaaatactgctntnacaaaagcagaatggaagc

SEQ ID NO: 34830 - DNA, 448 bp, Homo sapiens
  misc_feature 6: n = A,T,C or G
aacttnagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctaccctctacaacctacttcagttaaaattgtctaatacagcaatatttaaaaaaaaacactacaattgtcaaggatggaaaatgtgtgatttgtgtaaacaatttttaccaactttacattttcctacagataaatgtgaaattttgataagaagtctacgcaatgacaagtatggtacataaattttattaaga

SEQ ID NO: 34831 - DNA, 249 bp, Homo sapiens
  misc_feature 11: n = A,T,C or G
atatcgaaacntcagcctactcattcaaccaatagccctggccgtacgcctaaccgctaacattactgcaggccgcctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacac

SEQ ID NO: 34832 - DNA, 302 bp, Homo sapiens
  misc_feature 2, 6: n = A,T,C or G
cngttnttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattc

SEQ ID NO: 34833 - DNA, 215 bp, Homo sapiens
  misc_feature 1, 6, 7, 8, 27, 30, 31, 41, 66, 74: n = A,T,C or G
naaatnnnctaggtcttaccagagaantannaggagagaanaatagagagggcccctaaaaaaaanttaagaanaaattccccaaaatggaaaacaggaattctcaaaatgaaaggacccagtggatgaaaacagaccctacatcctcacccaaggcagtcatctcaaaattgcagaacccctcaagttagaaagaaaacccctacaactgtcag

SEQ ID NO: 34834 - DNA, 460 bp, Homo sapiens
  misc_feature 1, 13, 41, 43, 95, 96, 435, 446: n = A,T,C or G
nggccggggaaanctcggtgggtgggccccctgcgccagancnagacttcgctcgtactcgtgccgcccttcgcttcgcttttcctccgcaaccnntgtctgacaaaccccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaangaaagaacttnatgttgggtgaagg

SEQ ID NO: 34835 - DNA, 498 bp, Homo sapiens
  misc_feature 5, 15, 34, 35, 57, 58, 59, 498: n = A,T,C or G
aggcnccagtccccntaccccgggataccaaganncctgcagacctccccgagagannntaacacagaattgcacccatgcccaaactacaaactcacttacttttaatattgggggggagagcagaaattattcgttacatatttgcttatttggacatacagtatgaagacccacagaatagaacaagctgactggcctgaaatcaaatcaactctcccatttggaaaaatccccattttggaagttgatggacttactcttcaccagagcctagcaatagcaagatatttgaccaaaaacacagatttggctggaaacacagaaatggaacaatgtcatgttgatgctattgtggacactcttggatgatttcatgtcatgttttccttgggcagagaaaaagcaagatgtgaaagagccagatgttcaatgagctgctcacgtataatgcgcctcatcttatgcaggacttggacacatattaagggggggagn

SEQ ID NO: 34836 - DNA, 451 bp, Homo sapiens
  misc_feature 2, 70: n = A,T,C or G
anataaataatattttttctatatctcccctctttgctgaaagctgttgggtgagacatcacaatgaccnacttctatgtaaaaggtagattatagatggccctctgcatatgtgggattgcatctgcattcaaccaactgtgaatcaaaaatatttttaaaaaattgtgtctgtactgaacatgtacagacttttttcttactattattccctaaacaatacagtataacaactatttacctagcacttacttacattgtactagacattgtaagtaacctagagatgatttaaaatgcacaggaagatgtgtgtaggttacatgcaaatactatgccattttatatttgaggacttgaggattttgccatccatgggaggtcctggaaccaatcaatcccccacagatgctgaggaatgactgtacttgataaatgtctcttgaatcat

SEQ ID NO: 34837 - DNA, 118 bp, Homo sapiens
  misc_feature 9, 22, 42, 52, 85, 105: n = A,T,C or G
acctaacgnacgtgtcaccgtngttcctttaccgttgttccnagaaaaaganaatttaatgcctgtagtgacctttgctcacctntacccctagagaaataaacnaacctttcaatgg

SEQ ID NO: 34838 - DNA, 365 bp, Homo sapiens
  misc_feature 2, 23, 25, 44, 53, 61, 65, 70, 135, 154, 309, 315, 320, 349: n = A,T,C or G
angttcctgcttgcgtttttgancnggaggtgcccgtccccccnaattctctnggcagcantgcntgtantaggccgaacctcttactcagcctctgatgtttcagagagaagaccctcagaaacccgaaaaganaacccacccacccctcctnttgtgtcttgaagtttcaccgtgtgtttattgaaaatctaatgggaaatggatcacaccgatttctttaagggaattaaaaaaaataaaagaattacggcttttacagcaacaatacgattatcttataggaaaaaaaaaaatcattgtaaagtntcaagncaatncgagtaaatgaaaaggctgttaaaggtanatgacatcatgtgtta

SEQ ID NO: 34839 - DNA, 482 bp, Homo sapiens
  misc_feature 15, 32, 34, 38, 47, 48, 51, 54, 57, 58, 78, 79, 85, 101,108, 132, 147, 157, 203, 470: n = A,T,C or G
ctgggaatctcggcntctttgggccggggaancngacnttcagtgannganganganncaggaagtaaccagtcctanngagtantaaccagtggggatcnaggttcnaaagccctctgaaaaccaaccganaaaccaaaaaagaanaccagatgangtttcccaacacctaaatcatcttcccaaataccctgcccaaccantcagtagcaaaagttccctatgggaaaggaccttcatttaatcaggaacgtggaacatcttcacatctgccaccacctccaaagttgcttgcacagcagcatcccaccctccagatcgacaggcagtaccttggaagaccaggcccctttccctccaagcagcaagtagctgatgaagaatgaaatattggaagcaaaggaccgaaagaccaacaatcagaaaatttctgcagcagtagaaacgtgcctcgtaaaccggcgtgaagnaaggaaagaagc

SEQ ID NO: 34840 - DNA, 330 bp, Homo sapiens
  misc_feature 26, 27, 330: n = A,T,C or G
gccagttcttgccactttcctagctnntgtaactcttacttaagtgcctgtatttacttatcaaaaggaaaagaatttaaagtgattcaatatagggggttaaaaagcatttattcatctgggcgcagtagctcttgccctgtaatcccagcactttgggaggcccaaggtgggcggatcaccctgaggtctggagttcaaaactagccctggccaaaatggtgaaaccctgtttctactgaaaatacaaaaattagccaggtgtagtggcatgcaccctgtagtcccaggtcttgggaggctgaggcaggagaactgcttgaacccagn

SEQ ID NO: 34841 - DNA, 500 bp, Homo sapiens
  misc_feature 11, 19, 31, 57, 119, 427, 478: n = A,T,C or G
tggttccctgnttcgtccnaattgtccttcnttttttcttgcctcaattccagttantcaaaaggtaggtacctaatccaaactgcattttcaccctcctagcaaaggagttaaaatantgtcttattgttctccatgttctgtatgaagttcttactttgaaatgcagggcccttcattctttggcttaatcctctgaaactcactgaattttctagccttgtcatctaccaaaatgtgcacatatttgttgtaccttgggctgtcttaaaaaaagacatcatgaactctggagccagactatctagatcagaatcccacctgtaccacttactagctgtatgacctggggcaagtgacttaacctctctttgactcagcattctcatctatataataagaacaattaaaggtatctgacaggagnaatcagagcctggccaaatgaaacaggaaaagagggagcaaaaatgctggnttatttttttctgcttaatcat

SEQ ID NO: 34842 - DNA, 400 bp, Homo sapiens
  misc_feature 3, 4, 388: n = A,T,C or G
gannagcaagaagagtgcatctagtgagagtgaagctgaaaatcttgaagcacaaccccagtttactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggatcaaagtgggggnaaagatgggatc

SEQ ID NO: 34843 - DNA, 369 bp, Homo sapiens
  misc_feature 6, 13, 31, 33, 59, 60, 73, 184: n = A,T,C or G
tcggcntttattnggccggggcccggcttcntncctgcttagggggctttaagccggannggaggtcgagccnagcgtcgcccgcgatggtgttggttggagagcgagcagttcctgacggagctgaccagacttttccagaagtgcccggacgtcgggcagcgtctatatcacccttgaagangtatgacggtcgaaccaaacccattccaaagaaaggtactgtggagggctttgagcccgcagacaacaagtgtctgttaagagctaccgatgggaagaagaagatcagcactgtggcgagctccaaggaagtggaataaggtttcagatggcttattcaaacctccttagagctaacatggatgg

SEQ ID NO: 34844 - DNA, 242 bp, Homo sapiens
  misc_feature 6, 9, 10, 52, 64, 67, 100: n = A,T,C or G
tcgttngcnnttttgttaccttgcctacccctgagtacctttcaggaaaganctgaccttaaantanttcggggtgagtaaagtagttgggtattaagantctgaacttttcatctgcagaggccaagaaaaatatttgacattgtgaccttgactgtggaagatgatggttgcatgtttctagtttgtatatgtttccatctttgtgataagatgatttaataaatctctttaaatactga

SEQ ID NO: 34845 - DNA, 491 bp, Homo sapiens
  misc_feature 7, 8: n = A,T,C or G
ctcggcnntttattggcccgggatccccttttatagtttgtgcccttctgtgagcaaaactttttagtacgcgtatatatccctctagtaatcacaacattttaggatttagggatacctgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctatat

SEQ ID NO: 34846 - DNA, 291 bp, Homo sapiens
  misc_feature 21, 34, 38, 42, 47, 112: n = A,T,C or G
aagaagtttgagtcagccccntcttgcttttccntccntccntgtcnttcagtggggcccagcagggaggtgagccttacacccccctactcagaggcagtgaggtgatacnaggttggtgccctactttcattgggactaagagtggagctgaacttccgtcccaccccatctgcaacaaaacagtgtgagtcattgctccacttttgccctgggtgatgttggtgcggccccagaggggaagttgaacatacacacctccacctcaacaggaggactgcctgcttcggg

SEQ ID NO: 34847 - DNA, 283 bp, Homo sapiens
  misc_feature 7, 25, 118: n = A,T,C or G
tcggccntttatggcccgggatccnaccaaaaaaatttaacctccatatgtgttcctcttgttctaatcttgtcaaccagtgcaagtgacccgacaaaattccagttattttatttcnaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 34848 - DNA, 480 bp, Homo sapiens
  misc_feature 6: n = A,T,C or G
tcggcntttattggcccgggggggtggggagagaaggagagccctgcagacagaggccctccagcttggtctgtctccccacctctaccagcatctgctgagctatgagcccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattatgggagaaggtgtcccagtggctccgggggagacgttcagctaccctgactttctcaggatgatgctgggcaagagatctgccatcctaaaaatgatcctgatgtatg

SEQ ID NO: 34849 - DNA, 449 bp, Homo sapiens
ggcggacgcttgtgccggaagtaaacttgttaacggttctttgccttttggggaggggagacagcccagagaaggctttggagacccttgagtcggccagcgagcagggtttcttacttgagcgcctccacaaataaacgccccttcgctcctccgtcgcgtgcgtttccctgggataataagtgggaaagtggtggcttttatttttttgagacagggtctcaccgccgtcgcccaggccggatggagtgcagtggcgcgatcacggctcactgcagcctcgacttcccaggctcagagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattat

SEQ ID NO: 34850 - DNA, 500 bp, Homo sapiens
  misc_feature 3, 4, 48, 74, 450: n = A,T,C or G
gannccccagtagttgaaatgtattaactaaacccttagtattaatcnccaccaatgaaatacctgtattaacnaatgaaaatgaacccaacctaccagttaccatacaacattgataaatttcatataatgctacacaaaaatgcccagatatgaaataatacatacctacatgattccatttatattaagttttttaaaaactctaaactgtaggctgggtaaggtggttcacatctgtaatcccagcatttgggaggccggggcaggcagatcacttgaggccaggagtttgagaccagcctggccaacatagcgaaatcccatctctactaaaaatataaaaaattagctggtcattggtggcacacacgtgtagtcccagctactcaggaggctgaggcaggtgaatcacttggacccaggaggcaaaggtttgcagtgagcccngggtttgcaccacttggacttcagctttgggtgacccgagcagacttctg

SEQ ID NO: 34851 - DNA, 259 bp, Homo sapiens
  misc_feature 5, 19, 32, 50: n = A,T,C or G
aagantgaaagagtagtangtgggggagaganctgctggtctccagaccncagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgagg

SEQ ID NO: 34852 - DNA, 500 bp, Homo sapiens
  misc_feature 12, 14, 366, 449, 451, 455: n = A,T,C or G
ctggtgttctcnancccggtatggtggtcaccctttgctccagtcaacgttacaaccggaagtaaaatctgtcgaaatgcacccatgaagcctttgagtgaagcctcttcctggggaccaatgtgggcttcaatgtcaagaatgtgtctgtcaaggacgttcgtcgtggcaacgttgctggtgacagcaaaaatgacccaccaatggaagcagctggcttcactgctcaggtgattatcctgaaccatccaggccaaataagcgccggctatgcccctgtatttggattgccacacggctcacattgcatgcaagtttgctgagctgaaggaaaagattgatccgccgttctggtaaaaagctggnaagaatggccctaaattctttgaagtctgggtgaatgctgcatttgttgatatttgggtccctggcaagcccatgtgtgtttngnaaanctttctcaaaactatccaccttttggggtcgcttttgctggttcg

SEQ ID NO: 34853 - DNA, 261 bp, Homo sapiens
  misc_feature 259, 260: n = A,T,C or G
gactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttgcatagcatttgtgtaaagactatgatctcatcccaataaaatgatatattaaatcttcagattaatgactggctacagagtnnc

SEQ ID NO: 34854 - DNA, 490 bp, Homo sapiens
  misc_feature 9, 16, 31, 36, 51, 453: n = A,T,C or G
ccgggaaantcggccntttatggcccggganggtcntctgttgttaaattntgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgnggctagagagtttgaaggattgctttttaaaaaagac

SEQ ID NO: 34855 - DNA, 251 bp, Homo sapiens
  misc_feature 3, 20, 247, 251: n = A,T,C or G
gantgaagtttttaaaaatnaatgtgattttgaaaatctctaatggctcagaaaataaaaacatccagtttgtggatgactatatttagatttctctagactctagtggaagacctttggaaaggccatgccaaccgtgcttgtacctgctagaagcactttatgtttcctttttgagtgaaatggatttatgtgagtgctttaaacaaatagcaatacttatagactgaaataaaatgaaacttcnaatn

SEQ ID NO: 34856 - DNA, 395 bp, Homo sapiens
  misc_feature 2, 11, 37, 387: n = A,T,C or G
tntgcattgcnagtttgctgagcctgaaggaaaagantgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtggggtgtcatcaaagcagtggacaagaaggctgctggagctggcaaggtcaccaagtctgcccagaaagctcagaaggctaaatgaatattatccctaatacctgccaccccactcttaatcagtggtgggaagaaacggtctcagaactgtttgtttcaattggcatttaagtttagtagntaaaagac

SEQ ID NO: 34857 - DNA, 211 bp, Homo sapiens
  misc_feature 20: n = A,T,C or G
caaattaacaagcaaaaccnaacaatctcgttaaaaaatgggcaaaggacatgaacagacacttctcaaaagaagacatacatgtggccaacaagcatatgaaaaaaattttcaatatcactaatcattagagaaatgcaaatcaaaatgcaaatcaaaaccacaatgagataccacctcacaccagtcaaatggctattactaaaaagtg

SEQ ID NO: 34858 - DNA, 500 bp, Homo sapiens
  misc_feature 7, 22, 27, 402, 469: n = A,T,C or G
tcggccntttttggcccgggantttcnaaaagtatagggattcatgataattaaaccctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaagcaggtgtggagaatattgaacggctcagaagccgcgtcccttacttaacacaattccgaatctccctcatccatgatgcgtccattggatcactcgctggtggtcactggtnggcagttctagggggaattctgcctctgactgttctttttcttttgggtctttaaacaccctgtcgnggggatgtgctcactgatttgggctatgttt

SEQ ID NO: 34859 - DNA, 300 bp, Homo sapiens
  misc_feature 19, 28, 29, 205: n = A,T,C or G
tgaagcccctgttgcctcnaggagtgannaagttgctaatatgcagaagggatgggtgataccttcttgcttctcatgatgcatgtttctgtatgttaatgacttgttgggtagctattaaggtactagagttgataatgtgtacagggtccttttgcaataaaactggttatgacttgatccaagtgtttaacaattggggctngttaagtctgaccatacatcactgtgatagaatgtgggctttttcaaggggtgaagatacaagtcttaaccacagtgtaacttacagtttccttt

SEQ ID NO: 34860 - DNA, 430 bp, Homo sapiens
agcatcaataatttgtgtcagttttccttgcccctgaatccaggagtggggtgtgaatgcacccaggtggttgcctgcaaatgcagttggatacgttatagaagaggaaccctgagtgtaggaaacccaagtagcatgtagtgtgcagtaagcatgcctgctttttgctgttggaggcagatactttaggcaaatcttgttttattacactttgcttttgttgtgctttttaggtattgcattttttaaaaactgaaggtttgtagcagccctgctttgagcaagtctactggtgccatttttttttaacagcatgtgctcactttgtgtttctgtgtcacattttggtaactctcccaatatttaaaacattttctgacggggtcttaaagatggctgccaggtgaccgcttcctgacagacgaaaaat

SEQ ID NO: 34861 - DNA, 296 bp, Homo sapiens
  misc_feature 13: n = A,T,C or G
cttctggcaagangttctgcccttagcacctcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactac

SEQ ID NO: 34862 - DNA, 352 bp, Homo sapiens
  misc_feature 2, 3, 171: n = A,T,C or G
tnngtctggtcgcggcaaagtccggaaaggcttggggaagggtggtgctaagccgccatcgtaaggtgctccgggataacatccagggcatttacaaaacccggctatttccgcccgtttggctcggcgcggtggcgtcaagccgcatttccggtcttatctatgaggagnctcgaggtgtgcttaaggttttcttagagaacgttattcgagacgcccgtcacctatacggagcacgccaagcgcaaaactgtcacagccatggatgtagtatatgccctgaaacgtcaggggcgcactctgtatggcttcggcggctgaatctaagaatacgcggtctcctgagaacttc

SEQ ID NO: 34863 - DNA, 259 bp, Homo sapiens
  misc_feature 156, 158, 197, 205, 224: n = A,T,C or G
gagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgntngtaaaaaaaaaaaaagggtttcccccctgtttgggccanggctgggncttccaacttcctgacctnaaggggaatccaccctgccctcgacctcacaaaag

SEQ ID NO: 34864 - DNA, 110 bp, Homo sapiens
  misc_feature 10, 11: n = A,T,C or G
tggggaaganntaggtgcctgctgcctcaaaccacccttgtgtaaaatctgcaatacggcttcttccatgtacctgtgcctgaacctgtctgcaataaagaagaatttga

SEQ ID NO: 34865 - DNA, 499 bp, Homo sapiens
  misc_feature 7, 56: n = A,T,C or G
tcggccntttatggcccggggggcgcaatagatatagtacccgcaagggaaaagangaaaaaattataaccaagcataatatagcaaggactaaccccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtagagagagtaaaaaattttaacacccatagtaggcctaaaagcagccaccaattaagaaagcgttcaagctcaacacccactacctaaaaaatccca

SEQ ID NO: 34866 - DNA, 203 bp, Homo sapiens
  misc_feature 202, 203: n = A,T,C or G
tgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgtnn

SEQ ID NO: 34867 - DNA, 472 bp, Homo sapiens
  misc_feature 417, 466: n = A,T,C or G
tctgttagacttgaatgaaaagcaaatgatcttctttttaaatggcaaccagctgcctcctgaaaagcaagtcttttcattctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgagggtagcagacacacaattgaagccatgtggacacagtgacctgtgcatggattgtgccttgcagctggagacctgcccattgtgtcgtaaagaaatagtatctagnaatcagacagatttctcatatttcatgacacatgtgaagaggcattcgngggact

SEQ ID NO: 34868 - DNA, 500 bp, Homo sapiens
  misc_feature 3, 4, 42, 64, 388: n = A,T,C or G
ganncttgaagtgtcccctacacctaaagtccaaacacctantgtcagatgggggtaaaatccnttaaagaacaggaaaaaataattattaagatgataagcaaatgtttcagcccaatgtcaaccccagttaaaaaaaaaattaatgctgtgtaaaatggttgaattagtttgcaaactatataaagacatatgcagtaaaaagtctgttaatgcacatcctgtgggaatgggagtgttctaaccaattgccttttcttgttatctgagctctcctatattatcatactcagataaccaaattaaaagaattagatatggatttttaatacacttaacattaaactcttctaactttcttctttctgtgataattcagaagataggntatggggatctttcaatgcctctgagtcattgttataaaaaatcagttatcactataccatgctttagggagactgggcaaaacctgtacaatgacaacccttggaagttgc

SEQ ID NO: 34869 - DNA, 385 bp, Homo sapiens
  misc_feature 3, 11, 32, 33, 371: n = A,T,C or G
aanttcggccntttattggcccgggccaaganngtaaagggtttcaaggaggaagggcaggagattagcagtgtcagccctgaagagatcctgaggaggactgagaaaaatccactgggcttgcaaattaggcagccctgtgtaaaacatcaaaggcatatttttagtgcgtgttggtgacagaaaccagactgtgggggattgaggatgagtggagaaggagtgaagacaacaagccaagtactcttttcagtgggttttgtgataagagaggagagagtggtagctaaagaggatagtgagtgattgggaacttttttgtaaatataagagtcatgagaatgtttgatgttagaagaggaggggagtanggttggacatgggg

SEQ ID NO: 34870 - DNA, 476 bp, Homo sapiens
cacacagccccttgtatttctgtctgcatagaaccacagggtacagggtactaaatgaccttatggatttatagactgcaacaggagctatgaattctactagtattcaggccagctgcttagttcaatccatgctactcgccttctctttggtgatattctttgaagaggccgtgatcacatctttatcttgccagacacccaattgggaactgtgttctcattctcttccatgagcttctaggccctgtgctaataaatgcatgtggctaggtatctgttttagagctccttaataatcaataatcaattaaccaactactgaatagtccatgatagttgacatactgtttagtttaaagaagtggtgctcaaattttgacctgtatcagaatcgtctggagaactattaaattacaaattgctgggtcccatccccaggacttcttattctgtgggcttgggatgggagagag

SEQ ID NO: 34871 - DNA, 248 bp, Homo sapiens
  misc_feature 4, 17, 26: n = A,T,C or G
aatngcccggggaaaantagcctctngtttttggtttttttgttgttgtttttacagatttcaggttacaaactgcaaagtttatgcataattaagtatggtatggttgccagaaaagccctaaaattactacttagaaaatttaagactgtttacccccattgtcttgtacttgcgagctaacttgtactattcttgtgaaagcactgtcatcttttagtagcaaattttgataatgtttctcgtgg

SEQ ID NO: 34872 - DNA, 251 bp, Homo sapiens
  misc_feature 4: n = A,T,C or G
tacnagtatgtacctttggagggtggggggcatggcatctttcactcaaatcatgattttgatatttcaccatgcctgcagtatgtatcggtagttcaatcatttttgttgttgagtagtatttcattatatggatatataataccataatttatctttacctgttgatggatatttgggttatcaccaggtttgagatattacaaataaagatgttttgaacatttgtgtagaagttttagtggacttac

SEQ ID NO: 34873 - DNA, 231 bp, Homo sapiens
cagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagc

SEQ ID NO: 34874 - DNA, 203 bp, Homo sapiens
aagaagtgaaagagataccagggtagcaggcacagaattttatgtgaagtgaccggaaatggttaccttcaaggcaaagagagattcctggaggagattcttcttttaaggctcattatagaggaaatcatccttatctacactttgatcctggacttccagcctcaaaaattatgagcaaataaatttctgttgtttaagcc

SEQ ID NO: 34875 - DNA, 154 bp, Homo sapiens
  misc_feature 4, 16, 30, 42, 50, 51: n = A,T,C or G
gggnttggtggcgcantgcctgtaatcccngctacttgggangctgagannaggaagaattgcttgaacccgggaggccggaggttgctgtaagcccgagatctcacccattgcacctcccagccctgggcaacaagagcaaaactccatctca

SEQ ID NO: 34876 - DNA, 467 bp, Homo sapiens
  misc_feature 27, 361, 393, 394: n = A,T,C or G
gggtcaccagcagctgtactggagccncccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagaaagacctgagctgtcttccttggcactgcctatggaggtgacacccatctcctccatcatggccatcctgagaccgctcgcgaagcccaagatcatcaaaaagagcaccaagttcactgggaaccagtcagactgatatgtcaaaattaagggtaacttggtggaaacacagaggtattgacaacagggtcatagaaagntttgaggaccagatctatgcccaacattggtnntggggagaaacaaaaagacaaagcacgtactgcccagtggcttttggaagttcctggtccacaacgttaagga

SEQ ID NO: 34877 - DNA, 427 bp, Homo sapiens
  misc_feature 417, 420: n = A,T,C or G
gaggcattgaggcagccagcgcaggggcttctgctgaggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttaaaaagttgnganggggatt

SEQ ID NO: 34878 - DNA, 457 bp, Homo sapiens
ggcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaataga

SEQ ID NO: 34879 - DNA, 313 bp, Homo sapiens
aggtttggtcctagcctttctattagctcttagtaagattacacatgcaagcatccccgttccagtgagttcaccctctaaatcaccacgatcaaaagggacaagcatcaagcacgcagtaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaggccggcgtaaagagtgtttttagatcaccccctc

SEQ ID NO: 34880 - DNA, 217 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattggaagttgacttactgaaaat

SEQ ID NO: 34881 - DNA, 334 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatgggagatgacagttcagaagaggagggag

SEQ ID NO: 34882 - DNA, 374 bp, Homo sapiens
  misc_feature 306, 313: n = A,T,C or G
gaaaaagaaaaacttattcctgtgtcaggcaccctttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggctgaggcaggagaatcgcttgaacccgggagtggnaagttgntggaagagccaagattgcatcattgcactccagcttgggcaaaaagaatgaaactctgtct

SEQ ID NO: 34883 - DNA, 258 bp, Homo sapiens
acatggaaactgagcaacctgctcctgaatgactcctgggtacataacgaaatgaaggcagaaataaagacgttctttgaaaccaacgagaacaaagacacagcataccagaatctctgggacacattcaaagcagtgtgtagagggaaatttatggcactaaatgcccacaagagaaagcaggaaagatccaaaattgacaccctaatgtcacaattaaaagaactagaaaagcaagagcaaacattcaaaagctag

SEQ ID NO: 34884 - DNA, 471 bp, Homo sapiens
ggcggcatcttcaacagatacaatgtcattcgaattcaaaagttgtcaacaagaagttgagggagcggttctgccaccgacagaaggaagtgtctgaggagaatcacaaccatcacaatgagcgcatgctgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctaca

SEQ ID NO: 34885 - DNA, 217 bp, Homo sapiens
aggcatagttctgagatggaatgacttgaaaggctggtggattgttcaagaaatcagtgttttgttatcagattccctaatcataaatcctaggtcttaacctgtggtttagggaagacaggttttatttgggtagaagtgcagtcatgcagtttagtgatgtggaaaagaggcggaaagatttacaagtaaatgtttccttgatcattggatttag

SEQ ID NO: 34886 - DNA, 253 bp, Homo sapiens
gtgatgagcctatgtatgtcaagttggtggaggccctttgtgctgaacaccaaatcgacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctca

SEQ ID NO: 34887 - DNA, 165 bp, Homo sapiens
  misc_feature 30: n = A,T,C or G
gtacgactcttagacggtggatcactcggntcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 34888 - DNA, 258 bp, Homo sapiens
atttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttac

SEQ ID NO: 34889 - DNA, 280 bp, Homo sapiens
  misc_feature 29, 116, 237, 255, 275: n = A,T,C or G
gctcttccggggacgttgtctgcaggcantcagaatggtccagcgtttgacataccgacgtaggctttcctacaatacagcctctaacaaaactaggctgtcccgaacccctggtnatagaattgtttacctttataccaagaaggttgggaaagcaccaaaatctgcatgtggtgtgtgcccaggcagacttcgaggggttcgtgctgtaagacctaaagttcttatgagattggncaaaacaaagaaacatgngagcagggcctatggggggntccat

SEQ ID NO: 34890 - DNA, 331 bp, Homo sapiens
aaggcagaaagctcctaaggcatgattatatatttcttcttccagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatgttacaattgtaagagatgtttgaagctttggggatcttctaatggaaatgggggttcttcaccgaatgttcatgtaccgacttcaagaggtcaaagaatcacgaattgatatacaaagtggtgtatgttg

SEQ ID NO: 34891 - DNA, 431 bp, Homo sapiens
cagtgttttagaaacatgggtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttga

SEQ ID NO: 34892 - DNA, 490 bp, Homo sapiens
  misc_feature 8, 34, 35: n = A,T,C or G
aacaacancaaaaaactaccgaatccaaaataanngtctacaaccacacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctc

SEQ ID NO: 34893 - DNA, 393 bp, Homo sapiens
gtgcgtatatgtgtgtatacacacatgtgtgtgagtatatgtatatacacgtatgtgtggtatatatacacatatgtatgtatatacatatatatgtgtatatatatcatggctgggcatggtggctcatgcctgtaataacagcactttgggaggctgaggcaggtgggtcacttgagatcaggagttcaagaccagcctggccaacatggtgaaaccctgtgtctactaaaaatacaaaaattatcctggcacggtggtggatccctgtaatcccagctattcaggaggatgaagtcagagactcgcttgaacccggaaggcggagattgcagtgagccaagatcactccactgcactccagcctgggcaacagagtaaaactccatctca

SEQ ID NO: 34894 - DNA, 251 bp, Homo sapiens
  misc_feature 10, 243: n = A,T,C or G
aagacaaganggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagtaaaaaaaaataaaactctcattatttgtgtggctaattataattcagcgttatttaagcccntaaagacc

SEQ ID NO: 34895 - DNA, 377 bp, Homo sapiens
  misc_feature 17: n = A,T,C or G
ggggccctgctgaaaanatacctgaaaatgtggaagcagctttggacccgggtaacaggcagaggttggaacagtttggaaggcttggaagaagacagaaaatgtgggaaagtttggaactttctagacacttgttgaatgactttgacaaaaatgctgatagcggtatgtacaacaaggtccaggctgaggtggtctcagatggagatgaggaacttgttgggaactggagcaaaggtcactcttgttatgttttagcaaagagactggtggcattttgcccctgccctagtgattcctggaactttgaacttgagagagatgatttagggtatctggaggaagaaatttctaagcagcaaagcattcaagaacac

SEQ ID NO: 34896 - DNA, 468 bp, Homo sapiens
  misc_feature 21: n = A,T,C or G
agtaggaaaagcactgatttnggaagtaacattcccaggactaaagttcatagcaactagctgtttaaaccaagggtagtcagattatcttcctgggtctgttttttcccacatcatgtatttttcagaactatgttttcagtatatatttttatatcaagaaaatatgtggaatataagaaaattacatcaattaataagacatgaagcatatttctgtaaaaggatttgtaaatttgtctttcaccaaatttaaatgccctatatatttgtcaacagcctatttaaacaacagaaaattctatgaagtcttcagtggcctattgctctgcttttgaatttcttaggtgcttttgcttttcttgttgtctgtcttttaaatcagtttatgtctcatttatcaagcacataagtgagataaaagcagatgatcagctttattaaccctaataagaagttgcttgattg

SEQ ID NO: 34897 - DNA, 429 bp, Homo sapiens
tgagaggtatattatagttttgttatgaaagtatgtattttgccctgcccacattgcaggtgttttgtatatatacaatggataaattttaagtgtgtgctaaggcacatggaagaccgattttatttgcacaaggtactgagattttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggccccccct

SEQ ID NO: 34898 - DNA, 246 bp, Homo sapiens
  misc_feature 6: n = A,T,C or G
caaganctgggcattagatgtgcttgttgctactgggatgtcactgtttgtagcagagttgagaaatatgtatgtatattaatccatgcatatgtacacatctataattatttatgtgtgtacaaagctaaacatgagtttgtactgccgtcttcaactcaaaatttgtcccaaaattttgtggcatatgtttagattttaaagttgatattttccctattgacagaataaactcattaaaagagc

SEQ ID NO: 34899 - DNA, 364 bp, Homo sapiens
  misc_feature 7, 32, 42: n = A,T,C or G
aagcttngcccattgtcttattggcacatggntggacacggnatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacat

SEQ ID NO: 34900 - DNA, 479 bp, Homo sapiens
aacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttact

SEQ ID NO: 34901 - DNA, 471 bp, Homo sapiens
gtgagccgaaggaccccctctgagctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttc

SEQ ID NO: 34902 - DNA, 323 bp, Homo sapiens
  misc_feature 4: n = A,T,C or G
gacnccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttt

SEQ ID NO: 34903 - DNA, 457 bp, Homo sapiens
  misc_feature 31: n = A,T,C or G
gaatgcctgatgaagtttgaggaccactgtnttaaattatatagttacccttcctttatccaaagatgctttaatagatggactcaacttactgcaatcatactttgcgttccaatctataaatcattttttaatgtctaataggaaatgggaagtttaaaatatggcctttagacctacctaccaacctcttttattttatgcaactctcatacttgtgcatctactgaatcctgtccctcgttatatctatagttttagacatttggttataccgtgtgaaatcattctgaagagtttctttagtcttttctagggaaaataccaggctctaaatcatgttgcaagtgataagaaacctcatttgttttaaaaatgcatcatttttctgatattaccccatgttagaagagcagatgccatggaagtacaagactatgaaaaagtagcaataatt

SEQ ID NO: 34904 - DNA, 254 bp, Homo sapiens
  misc_feature 234, 246: n = A,T,C or G
gatgtcttcatgtcccacaggcacttacccttaagggagatctgctcattatcaagggcaaggttatagatgaatcactgagagttctaccattgtgcacagaaatttggtgtgaagggctattttactaagaccctgaaacacaatattccccatctgttcataaagtagcttatttgatacacacaatgtggtcataaatgctcttctattctctgaatgcttgcttttggncatgaactggcncacaccca

SEQ ID NO: 34905 - DNA, 457 bp, Homo sapiens
gtggaaaagagtttggcaatttctcaaacagttaaacagagttaccatgtgactcagcaattccattcctaggtaatatccaaaagaattgaaagcaggaacttaaacagataacttgtgtaccaatgttcatagcagcattattcacaatagccaaaaggtggaaacaactcatatgcctgtcaacagatgaatggataaacaatgtggtgtatacacataatggaatatcattcagctttaaaggaatgaaattaagaaatgaaattctgcccaggcatgggggctcatacctgtaatcccatctctttggtaggctgaggcaggcggattatttgagcccagtagttcgagacccacctgggcagcatgtctctactactaaaaatataaagaatgagccaggcatggtggtgcacacctgtagttccagctgctcaggaggctgaggtgggga

SEQ ID NO: 34906 - DNA, 443 bp, Homo sapiens
  misc_feature 7, 32: n = A,T,C or G
ggcattnggaggctgacacacagtaattactngtagtacttgttggcttgcagacaggtgggggttgggcctgcagaatcccctgcagcattttcctgtaatctggatgagcgatcttcaaacgtgtgctttcaaactacttaaataccatattcttcctatcttgcctttcatttttatattaccacagatactttcctcatagtcttgccagtgcttgtagaatgcttagaaaaagcttgataaaccactgggctaagtacacagagggagaggctagcagtatttttaaattggtttctaaattttttatagcttgatggtagataacacatttgcttcattgaagtaatctgaaaaaccaatcctcaaaagacctctcaattagaattcttaaatgacaatgttttctttatcatatatttgagagattgatttaaaga

SEQ ID NO: 34907 - DNA, 103 bp, Homo sapiens
  misc_feature 5, 6: n = A,T,C or G
ggaanngctagaaaattggaataccttcgcttatgtggctgttgattgactttgtgattcagtgggccttgatatattagaaaaaagtcttttcttttctctt

SEQ ID NO: 34908 - DNA, 477 bp, Homo sapiens
attaatgaaaatgttcatttatgtagctgcctatatttccagggaaacataggacaagccagcaatattagtaatcttcattatgcaaatgttcataactctgattttcattaatacacgagctatgtgtatgtagcagtttggcaaggagaacagtcattatttaggtgctcagcatattcaactttggtcttagctaaatccaccgatccctaacgctcctcaccctacccttccaaataggaagaatagccaaaataattttatcatgaaaaatggaaatttcctacaaacgggagcctaatacttgggattgattggtcaatggactgagtaaatttaaataaggtagactatgcacctattgtaggctttgcaaatcctccaggcaagttcattctaaatggaattttgcctgtgcaaatacaatgcatgtactaagaattgtacttaagcctcaatacggagcattgaatt

SEQ ID NO: 34909 - DNA, 477 bp, Homo sapiens
  misc_feature 32: n = A,T,C or G
gtgctcctgcggggtcactcccactttgttantgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaaggatggcca

SEQ ID NO: 34910 - DNA, 117 bp, Homo sapiens
atatttaggccatgtatttttgctcatgtacaatcatgcttttttaaaggtaaactttgcaggacctggaaacagatttgaggaaagatccagacaggtgaattgcctattttattt

SEQ ID NO: 34911 - DNA, 387 bp, Homo sapiens
  misc_feature 6, 32: n = A,T,C or G
gggttnagaaaatgtggtatttatacataatngagtagtattcagccatgaaaaagaatgagatccagtcatttgcaacaaaatggagggaactggagattaccattttaagtgatataagccaagaacagagagacgatcaccacgttctcacttatttgtgggatctaaaaatcaagcaattgaactcatggagatagagaatagaaagatggttaccagaggttgagaaaggtagtgggtgattgagaagcgggtttggttaatggcacaaaaaacagaaacaatgagtaagatctagtatttgataccaaaacatgaagactacggtcaaaaataaattaattgtatacctttaagataactaataatataataattatgttg

SEQ ID NO: 34912 - DNA, 488 bp, Homo sapiens
  misc_feature 15, 18: n = A,T,C or G
atcctaaaatttatnagnaaaggcaagattactagaatagccctgaacagttttcaaaaataataaagctggaggagtcatactatctgattttaagacaactaaaaagtttacagtaatcaaggcagtgggggtattcatgaaattacagacacatagatcagtggaacagaaaagaaaattcagaaataaacccacaacaagtatggttgattgatatttggcaaaacaacaaaagcaaattaatggaaaaaggacagtcttttcaacaaatattgaacattgatgctggaaccattggatatatatatgcaaaaacattaacctcaacctaaacctcatgcctcataacaaaaattaactcaaaatggatcatggatctaaatgtaaaatgaaaaactttaaaacttttagaggaaaacataggagaaaaccttcattacctgaggttagcaaagagttctcagatacaacaccaaaaccaatca

SEQ ID NO: 34913 - DNA, 420 bp, Homo sapiens
  misc_feature 29: n = A,T,C or G
agactgagtgacacctagtggaatccatntatgtttctataggcatgtgttttgccggtccagttcctgtacagtaatatgatgaacacaaagagagagcaaactcatttttggaaggaaagaccctaaattgactgagagaggagtcacaggcctgtgaacctagaagaccctgaaagagcctttgacagcaaggttttgagggaccctttaaccttgtttgagttcaaaataaaagtttacctgtaactggcatgagcctagaccaatagttctaaattttttaacctaagcccttagtaagaaataaattttacataatgacccagtacacacctgtatatatttttataactgaaacaagtgtgtcaagaaatggtactttgttttgctctatgcagtgcactctgatattttctg

SEQ ID NO: 34914 - DNA, 433 bp, Homo sapiens
  misc_feature 433: n = A,T,C or G
ggcctcggaggtgggcaaagggaagtaacatacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgtaaaatagn

SEQ ID NO: 34915 - DNA, 474 bp, Homo sapiens
ggccccgtagattccttgaggacaaagctggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcac

SEQ ID NO: 34916 - DNA, 180 bp, Homo sapiens
  misc_feature 5, 28, 40: n = A,T,C or G
caaanttaaaagaagtgggatgatgacnttgtcttcaagnaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtgaaac

SEQ ID NO: 34917 - DNA, 105 bp, Homo sapiens
  misc_feature 31, 33: n = A,T,C or G
caatgaactgtgtcacctaagtaagctaccntnctattcgttgtttaaatatatggttctctatttgagtctgtgttttcaataaagttctatgttaaaattggc

SEQ ID NO: 34918 - DNA, 243 bp, Homo sapiens
  misc_feature 7, 243: n = A,T,C or G
attgctnatagttctgtgtgagcctgcagtgttaagtaaaacctattgagtgcacaaaaaaatcatgttacaattactacaaaatagagaaaccacctaggttaccaagatgtcaaataatggattaatggaagaaagtaatgtacctccttggtagcctacataatccaccttaatttgttatttcttatttaactattttgctatgtcttaagaaatgtatattaagtgaaaatggatgcn

SEQ ID NO: 34919 - DNA, 464 bp, Homo sapiens
  misc_feature 9, 31, 32, 33: n = A,T,C or G
ataaaaagnaaacctaataggaaaaaaaaannntaaatttgacttagtaaaaatgtaaaacttttttataatgtttggctaaatgtgtagaccatccaatatctaaatatttgcagacatcaaaatctacactgtctagtatggtagccactggccacatgtgagtatttaaatttaacttaaataacataaaaaaattcaggatctcaactgcactagtcacatctcaagtgctcagtagccacatgagactagtagctactgtactagacagcacagtactagaacattcctagctttaggagaagttatattggataggtgatgatccaaatgtttcactcaaatgttacctttaggccaaacatttcacattaagtacctggttttccattaattcattactacttcttgctaactattgtgcttgacactggagagaaaatgataaacaatacaagttt

SEQ ID NO: 34920 - DNA, 304 bp, Homo sapiens
cacagcagcaatgcaactcatcactctagtaaaagcaagcttaggctacctgaaagattttcccttggaagtttagcgtatgtttgactaacaagaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcat

SEQ ID NO: 34921 - DNA, 118 bp, Homo sapiens
  misc_feature 67, 74, 88: n = A,T,C or G
cccggcaacggccttcccttgccttccctgggactttccacccggcttggttttccgccttcttcgncccggangggaaaccaaggtncgggttccaagggggaaaggccccccgggc

SEQ ID NO: 34922 - DNA, 418 bp, Homo sapiens
  misc_feature 11, 30: n = A,T,C or G
atttttaaatntttttgtgagaagtttgtnttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagtcctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatattagcagtca

SEQ ID NO: 34923 - DNA, 489 bp, Homo sapiens
  misc_feature 6, 10, 31: n = A,T,C or G
acattnccgnaatttaagttttgagcctgtncctgtaaactggccataggaccaactgtgggaaaggataactgctttctaagtcaattttagcccatatatcagtacttattaatgttaaatgaagcaataggatagatctctgtaaaatgctatgtggttatttgtgtcattcatcatgtatgcagcactactttatctgtgtctctacctgaatattacacaggtgaatataaaaatatatctgaaagtatttctaattttctagagaaatttccaaatataaatctaaaattatattaaccaaagagtattacattcaaatttattaatcaggctgggcatagtggctcattcctgttatgccagcattttggaaggccaaggtgggaggattctttgagctcagaagttcgggactagcctgggcaacacagcaagatctcatttccactaaaaatcaaaaagagtagccaagtgtggcgacat

SEQ ID NO: 34924 - DNA, 388 bp, Homo sapiens
  misc_feature 6, 13, 387: n = A,T,C or G
ggactngcgaggnaggagttgagagaacggttcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaanc

SEQ ID NO: 34925 - DNA, 173 bp, Homo sapiens
ctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaagggg

SEQ ID NO: 34926 - DNA, 407 bp, Homo sapiens
  misc_feature 31: n = A,T,C or G
caggaaatgcatcaaaagacttaaaggtaangcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagtttggaagtttaattagctttccaaccaaccaaatttctgcattcgagtcttaaccatatttaagtgttactgtggcttcaaagaagctattgattctg

SEQ ID NO: 34927 - DNA, 438 bp, Homo sapiens
  misc_feature 14, 31: n = A,T,C or G
gctggcagccaagnagtggtaatggcgtctntatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacggatgaggaagatgaaagattttgaagaaga

SEQ ID NO: 34928 - DNA, 337 bp, Homo sapiens
  misc_feature 7: n = A,T,C or G
gaaaatnataacttcgtgctttgtgagagactctgtcaagagaaggaaaggacagccggacgtggtggctcatgcctgtgagcccagcacttttggaagccatttggcgggatggatcccttgaggccaggtgtttgagaccagcctgagtaacaatagtgagaccccatctctacaaaaaatgtaaaaattagccagggatagtggcacgcacctgtagtcctagctactccagaggctgaggcaggaggatcacttgaacccaggagtttaaggctgcagtaagctgtgatcatgccacaacattccagcctgggcaacagagcaagacatttct

SEQ ID NO: 34929 - DNA, 383 bp, Homo sapiens
  misc_feature 12, 30: n = A,T,C or G
ctaggctcaganacaccaaccttgcttctnggaaattctatcacctaatgcaagttacaggacaggtcagactcaaggggtggggaaacacacaccacctcttactggaaggaactggaaattcatatagccaagcaagtggacacagggacatatgactgttagagggcatgttcctaattaatctatcatttatatgatatgtgtgaaataatatatcaatagttatatgtatgaatatgaatatatataaattgatatattatttcatatattttcgggaattcatgcaggtctctgaggagttagcgtccagagtacatacatatgtgtatgttttctagttagttagatacatgaaatatacatcatgtatgatatat

SEQ ID NO: 34930 - DNA, 425 bp, Homo sapiens
  misc_feature 6, 32: n = A,T,C or G
ggtggncgacgggtcctccaagaagtttgggncgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattga

SEQ ID NO: 34931 - DNA, 455 bp, Homo sapiens
  misc_feature 6, 32: n = A,T,C or G
cggggngggatagcattaggagatataccttntgtaaaagacgagttaacgggtgcagcacaccaacatggcacatgtacatatatgtaacaaacctgcacgttgtgcacatgtaccctagaacttaaaaccaacgaacaaaaaaaataaggtgtttgtttcacttattttcctttttctttgtccttttgtttctttgtgcatgattcatttcatagtcatttcagtagaggggagtcactaatcactgataaattttatatcctgacccccaggggctgcatgcatgattaatgaacttgtctttcttctaaagaacaacgatctttaggtcatgcagacctccctgatggcatccagaagtttgaccgaggggtgcagacaggtgttgatcattgggggatgtcacctcccggatacccacctcactcatgaaagcccccagttatgtgaga

SEQ ID NO: 34932 - DNA, 206 bp, Homo sapiens
  misc_feature 12, 31, 32: n = A,T,C or G
agtcttcgaacnaatgtgtttgttcgatttnnaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattact

SEQ ID NO: 34933 - DNA, 260 bp, Homo sapiens
gagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttag

SEQ ID NO: 34934 - DNA, 466 bp, Homo sapiens
  misc_feature 31: n = A,T,C or G
acaccatagcagtctaagtgtttttgtgtgntagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaaca

SEQ ID NO: 34935 - DNA, 337 bp, Homo sapiens
  misc_feature 15, 23, 30, 31: n = A,T,C or G
gagtctgtatgggtncacgcacnccggtcnnagctcatcttggcgcatatgccggctgctatatttgagttcctgctcggccccagattggtccttgccatctccttccatctgcccattaactcccgcaagtgcctccgtgaggagattcacaaggacctgctagtgactggcgcgtacgagatctccgaccagtctgggggcgctggcggcctgcgcaaccacctcaagatcacagattctgctggccatattctctactccaaagaggatgcaaccaaggggaaatttgcctttaccactgaagattatgacatgtttgaagtgtgttttgaga

SEQ ID NO: 34936 - DNA, 164 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatc

SEQ ID NO: 34937 - DNA, 346 bp, Homo sapiens
aagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttga

SEQ ID NO: 34938 - DNA, 394 bp, Homo sapiens
  misc_feature 7, 33: n = A,T,C or G
aactacntaataaaaacactcttaataaataanacatataaagttttatttgtgacaaactcacaagcaaaaggaaggaaaataacatttgagccaagcatcctgctttatagacttgtgattcactgtcttacaacagtcctagcaagtagacatgatgcctgtttcacaagtgggaagcctgaagcccatgaaagtatgaatgaggagttcagtgtggataccaagtttcagtttgaaaacataaaaagttctggagaagaatggtgatgatagttgcacaacagtgtgaatgtacttaatgccacagaactgaacactgaaaaatgattaaaatggtaaatgttatggtatgtatattttaccacaatttgcttaaagcttgttaataatg

SEQ ID NO: 34939 - DNA, 235 bp, Homo sapiens
  misc_feature 7: n = A,T,C or G
gaaagtnccgaaactggttcagtaccttgattagttccagaaaccagaaggtaccctgtggcagtagccgctgctggagatctgatgtacctgctcaaagccgaagactccgccagaaccctcctttacgcccacggcccgcctgtcacatgtctagacgtctcggccaaccaagttgcttttggtgtacagggtctgggatgggtgtacgaaggaagcaaggtacacaactaac

SEQ ID NO: 34940 - DNA, 348 bp, Homo sapiens
  misc_feature 5, 13, 30, 32: n = A,T,C or G
aagangagacagnatatgtgcagagttgancngtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagac

SEQ ID NO: 34941 - DNA, 192 bp, Homo sapiens
  misc_feature 6: n = A,T,C or G
gtggcngcgacgacccattcgaacgtctgttctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 34942 - DNA, 471 bp, Homo sapiens
  misc_feature 6: n = A,T,C or G
gggatngtgtcttcagtaattcataacaggttttgttgctttttaaatcaaacatagtaaagatttccttttatgctctccttttagctacttggcttctggagtgttactctgttttcctaaatttacagtagctgccagtcttgtgctgagttctcctccaagtacactgaattgtgcaattcttgcttggcccagttttggacaggcatctttcccagaaccaagtggtcttctcagaggttaaacagttttggcaaaaactgtaaataatgactgaataaaaccataaaaactgaaatcttaagaacaggggaaaaagatgattcctgactgcaagccacatggatgcagaggacccatttttttaaaaaaagtttgtttctctattcaagccttcttaagtttgatcattcttatgatcttctctttgcctcaaataaaaccaccaatattgtgccttttatgact

SEQ ID NO: 34943 - DNA, 342 bp, Homo sapiens
  misc_feature 11, 31, 45, 46, 62, 110, 151, 164, 229, 241, 283, 335, 340: n = A,T,C or G
aatcctaaagntgtgtgcgcctttttatttntgtttttaatgctnngatatttcaatgttancctcaatttctgaacaccataggtagaacgtaaagcttgtctgatcgntcaaagcatgaaatggatacttatatggaaattctgctcanatagaatgacagnccgtcaaaacagattgtttgcaaaggggaggcatcagtgtccttggcaggctgatttctaggtangaaatgtggtancctcacttttaatgaacaaatggcctttattaaaaactgagngactctatatagctgatcagttttttcacctggaagcatttgtttctacttngatanga

SEQ ID NO: 34944 - DNA, 337 bp, Homo sapiens
  misc_feature 29: n = A,T,C or G
gatggcgaaaaagttgtcttttcctgttnttacttaagaaattgttaggtatttcatgacactgaaacagagcaataattgatgtattcaacagtccacctctgtatgatgatgtgaaagtgcaatttttctctttggtgagtaatcaagaaacagcctctgccattgttcttgtctggtcttttgaatgattttatttaagatttgctttactacacttcccaacaagggagatgacagatgtcatcccacagagggagggtgagaaaaacaataaatcagatttataacagatttttttaaaataacatatgtaatttgaataatttttgttcat

SEQ ID NO: 34945 - DNA, 466 bp, Homo sapiens
accaccataatatattactatgcactcatctctttggaaaaaaatgtatctcataatatcaagtgttcctaaggatctagagcaatggaaactcatatactctaagtgatatgattttgacttgtctttatctacagcttggttttatctaagaaggttgaagctatgcatattctacgatacagcaattcctttcctagggtatgccagagaaactctcgcacagatatacatgtaaaggatgtttgtagtatcagataggccccaaataaaaacaatcaaaaaccaatcagcagcaaaatagattaactgattgtattatagttatataaattgagtattaggcagaaagaaaaatgaagtagagctacacaaatcaacacagacgatgtcacagtattgcactaaagaagcaagccataaaagattacataaaatataactttcttgtattcttatacagttt

SEQ ID NO: 34946 - DNA, 310 bp, Homo sapiens
gtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatga

SEQ ID NO: 34947 - DNA, 147 bp, Homo sapiens
cgtgtcaaaggcttaacaaactttgaatagtaaaggaattttctcaacacaaacacacacacacagccatatttgtgtatacttgcaatgaacatgtggaaaacaaaatttagaatacaataccacttataatcactttaaatactt

SEQ ID NO: 34948 - DNA, 490 bp, Homo sapiens
  misc_feature 6, 31: n = A,T,C or G
agatgnatttggggaaaaccaagtttttttnaggtatatgtcatttcaggaattcctagggcctgtaactgataaaaatatattgcgactttccacaagcagaaatagcatagaattattgcgccaaagcttttcgaccatagaatatcacctgaggaatacgctttgcaaattgctacagtaatctctctctcactgctgcacccacgcttcactgaatgtgtggtgtagaatgggttctgatcctctcccacctgatgatatggttgtccccacactggcttttttcttttacttatggcaagcgatcggcctgataaagctgaaactactaatgggctattcaggggctttcatccacctgagtccaaagcctttgcaaaatgacttcccggaactcagaggcagtctgcagctggagcagttagcacttcgccagaaaatagtttgtcttcgttttcagtgtatttttcttttctcagaagaaaga

SEQ ID NO: 34949 - DNA, 490 bp, Homo sapiens
  misc_feature 6, 466, 485: n = A,T,C or G
gacttntaactcacagtaaaagcaaaagcttagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtggacactccagggctctttgacaccaaggagagcctggacaccacctgcaaggaaatcagccgctgcatcatctcctcctgcccaggtccccatgctattgtcctagttctgctgctgggccgctacacagaggaggagcagaaaaccgttgcantgatcaaggctgtctttgnggaag

SEQ ID NO: 34950 - DNA, 158 bp, Homo sapiens
  misc_feature 7: n = A,T,C or G
aagaaanaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctc

SEQ ID NO: 34951 - DNA, 325 bp, Homo sapiens
agaacaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatggagactatgcagga

SEQ ID NO: 34952 - DNA, 464 bp, Homo sapiens
  misc_feature 31: n = A,T,C or G
agatttaaagggagggaaatgaaagggtgtncatatccagaagcaaagaaaggtagtctctttttccaaagctgactcagtgcttatggagctaagtgtttcacagttggagaagtaggaaggcaaactgctaagagcactaggaactactcatgcattgtctgtattcctgaagggtagaaagtggagtactccaagggtattgctctgtgatcgttaggagggtttggagtcagatatccttgagggggtgtcaccttccatagtctgtagccattggaagtgtgtcagtgcttccaacaataaatccaccttagctcagctatgcagcaaccgaaatagcacgctactggtacaaaaacaggcacatagaccagtggaacagaatagagagcccagaaataaggccgcacacctacgaccatttgattttcaacaaaactgacaaaaacaagcattgggga

SEQ ID NO: 34953 - DNA, 333 bp, Homo sapiens
  misc_feature 36: n = A,T,C or G
ctatatgcaaatattaatagtagctctattctaatnccaaatcaacccaaatagccttcaacaggtgaatggataaacaagctctggtatagtcatacaacagactactactcaagaataagaactgctgcatacaacagtgtggatgaatctcaaaggcactgtgttgagtgacagaagccagtctcaaaaggttacatactaaaagattctatgtatatgatattctggaaaaggcaaagttatagggatagagagtagatcagcgattgtgaggaggtaggggttaaagaaggattttactacaaaggtgcaatgcaaggaagttttggg

SEQ ID NO: 34954 - DNA, 402 bp, Homo sapiens
aggcacaagaagggaatgacaaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgttttaccgtagaccagaaccaatttagaagatagaagtttgaagtggaaaactggaagacagaagtacgggaaggcgaagaaaagaatagagaagat

SEQ ID NO: 34955 - DNA, 177 bp, Homo sapiens
aaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaacc

SEQ ID NO: 34956 - DNA, 365 bp, Homo sapiens
  misc_feature 29: n = A,T,C or G
caggattgttccactaaaatttatttttnaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtgg

SEQ ID NO: 34957 - DNA, 428 bp, Homo sapiens
gagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttac

SEQ ID NO: 34958 - DNA, 224 bp, Homo sapiens
  misc_feature 52: n = A,T,C or G
ggaggccttgaggcagccagcgcaggggcttctgctgagggggcaggcggcncttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 34959 - DNA, 314 bp, Homo sapiens
gaaatggagccgcccatcacaatccagggtacgaggccaggatctatgttccaggaactcaataactatctctaagaaagaaaacacaaaaataagtatcccagggaagactcctgaatggcaactcatatgccagcagccagcatcaagtcattttctaagtttttgtgccgtgaagtgctggcgacagctgtttagtgtcctgcatacttttctcaggcagcccttgcatctgttccacaccccttaagagagaattaaagagagaaaacaaactctgttgacagaaggaggtgtaggcctttatggcattc

SEQ ID NO: 34960 - DNA, 240 bp, Homo sapiens
catcctagcaataatccccatcctccgtatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatg

SEQ ID NO: 34961 - DNA, 320 bp, Homo sapiens
gaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttat

SEQ ID NO: 34962 - DNA, 107 bp, Homo sapiens
  misc_feature 6: n = A,T,C or G
catganatcacatagttggagaccactttttctttttaaaaatgtttttgctattacaagacttttgcatttttatataggttttagaatcagcatgccagtatccc

SEQ ID NO: 34963 - DNA, 466 bp, Homo sapiens
  misc_feature 28, 30: n = A,T,C or G
atatccgaatctacaatgaactcaaacnantttacaagaaaaaacaaacaaccccatcaaaaagtgggcgaaggatatgaagagacacttctcaaaagaagacttttgtacaaccaaaagacacatgaaaaaatgctcatcatcactggccatcagagaaatgcaaatcaaagccacaatgagataccatctcacaccagttagaattgcgatcattaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcccattactgggtatatacccaaaggattataaaacatgctgttataaagacacatgcccatgtatgtttattgtggcactattagcaatagca

SEQ ID NO: 34964 - DNA, 141 bp, Homo sapiens
gtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattgga

SEQ ID NO: 34965 - DNA, 183 bp, Homo sapiens
gagattagagccttataggagaggttggagggagttgcctggcctccctctcccatgtgaagactcagcaagaaaacattatttaggaagcagagagccctcatcaaacaccagatctgctggccacctgatctggcactttccagccttcagaactgtgagaaataaatttctgttgtctat

SEQ ID NO: 34966 - DNA, 129 bp, Homo sapiens
  misc_feature 90: n = A,T,C or G
ctagctgggcatggtggcatgcacttgtagtccagctactcgaggctgaggtaggaggattgtttgagcctaggagggccaggctgcagngagtgatgattgccccctgcactccaggctgggggacag

SEQ ID NO: 34967 - DNA, 131 bp, Homo sapiens
agattaatacaactacttaaaaatatagtcaataggttactaagatattgcttagcgttaagtttttaacgtaattttaatagcttaagattttaagagaaaatatgaagacttagaagagtagcatgagg

SEQ ID NO: 34968 - DNA, 165 bp, Homo sapiens
  misc_feature 8, 16, 18, 19, 24, 28, 30, 33, 38, 40, 44, 118: n = A,T,C or G
gaactacncttatcgnannctcangtcngnttntgcgnanaggnagaacgcagctagctgcgagaattaatgtgaattgcaggacacattgatcatcgacacttcgaacgcacttgcngccccgggttcctcccggggctacgcctgtctgagcgtcgcttgccg

SEQ ID NO: 34969 - DNA, 352 bp, Homo sapiens
  misc_feature 7, 108, 147: n = A,T,C or G
aacacangaattacatacagcaacaaaaagtatctcttctttcctactacaaaactgtgtaatatcaggttctgtcaccatgtttaggttagtaaatgctcttaaagnctattactattgagtgaattgctaaaaaaaataattatngctatcatcctgggcagacttaatcatgtgtggtagttagttttagtagagacatgccccatctttggttaaaatcaaacagggaactatcacctagctttgtttaaacagtaaacttatagaactatgctttcactactggttatgaatgcctgacagagctttttagtagtttatattcagtttacatttatttagacagaac

SEQ ID NO: 34970 - DNA, 277 bp, Homo sapiens
  misc_feature 243, 247: n = A,T,C or G
ccggcggtgacgacctacgcacacgtagtaacatgcctctcgcaaaggatctccttcatccctctccagaagaggagaagaggaaacacaagaagaaacgcctggtgcagagccccaattcctacttcatggatgtgaaatgcccagggatgctataaaatcaccacggtctttagccatgcacaaacggtagttttgtgtgttggctgctccactgtcctctgccagcctacaggaggaaanccanggcttacagaaggatgttctttcaggagga

SEQ ID NO: 34971 - DNA, 128 bp, Homo sapiens
  misc_feature 4, 18, 31, 108, 117: n = A,T,C or G
aganaagattaaaatttncttaaaaagctgncatctcttcctctcttgccctcccaccaccaataactttaaggggaagagaagctggtttttttccctaaacatgtntttaaaatnatgatacactg

SEQ ID NO: 34972 - DNA, 160 bp, Homo sapiens
  misc_feature 5, 29, 31: n = A,T,C or G
gacanacacttgagcacacgcgtacaccnantacatcttcgggctgctattggattgactttgaaggttctgtgtgggtcgccgtggctgcatgtttgaatcaggtggagaagcacttcaacgctggacgaagtaaagattattgttgttattttttttt

SEQ ID NO: 34973 - DNA, 247 bp, Homo sapiens
  misc_feature 88, 100: n = A,T,C or G
gggcctgcctgcgttgcagtttaatattaagctatacttccctttcaaataaggtattttcatcgttaagcctgtaaaattctagttngtcattgtttanatatttatagtcttttaatatatctgtttacggccagctgcaatggctaacacctgtaaactcagcactttttgaggccaaggtgggccagattgagctcaggagttcgagaccagcctgggcaacatagtgaaactccatctatac

SEQ ID NO: 34974 - DNA, 174 bp, Homo sapiens
  misc_feature 31: n = A,T,C or G
cagaacagcagactcagctctgacattctgnttcgaatgacactgttcaggaatcggaatcctgtcgattagactggacagcttgtggcaagtgaatttgcctgtaacaagccagattttttaaaatttatattgtaaatattgtgtgtgtgtgtgtgtatatatatatatatg

SEQ ID NO: 34975 - DNA, 378 bp, Homo sapiens
  misc_feature 30, 342: n = A,T,C or G
gggtgtcatcaaagcagtggacaagaaggntgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcncagaattttgagacccattaaaaaagttaaatgagc

SEQ ID NO: 34976 - DNA, 105 bp, Homo sapiens
atcatgcagcatagacgaagatcagagagaatcatacagtaagatcatctaggacaaaatagccaaactgagccaagaagtagtgatgttggagtaaatgggcct

SEQ ID NO: 34977 - DNA, 381 bp, Homo sapiens
  misc_feature 20, 31: n = A,T,C or G
gcggcgggtgtcatcaaagncagtggacatnaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 34978 - DNA, 478 bp, Homo sapiens
  misc_feature 16, 31, 32: n = A,T,C or G
gacaacccttagccgnacctttacccaaatnnagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcag

SEQ ID NO: 34979 - DNA, 115 bp, Homo sapiens
  misc_feature 6, 26: n = A,T,C or G
caaatnaaaggaagcatacctttatnaagtatgctattaaaattgaacatcaagtataatatttcatttggattctcttttttggttaatgcctaaaaatgcctatttgggatct

SEQ ID NO: 34980 - DNA, 229 bp, Homo sapiens
  misc_feature 28, 31: n = A,T,C or G
ggcccggcaggcagatgtttgctgaggnttngaagcagcctgaccaacatggtgaaaccctgtctctactaaattaaaaaattagctggacgtggtggtgcatgcctgtggtcccggttactcagaaggctgaggcaggaaaatcgctcgaacctgggagatggaggttgtagtgaaccgaaatcgcaccattgcattcaagcctgggcaacagagccagactccgtcc

SEQ ID NO: 34981 - DNA, 159 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttac

SEQ ID NO: 34982 - DNA, 228 bp, Homo sapiens
  misc_feature 30: n = A,T,C or G
gttcccgcataaactcaaagtccaaactcnagagtcttattgaaatcaaatagaaaaataaataaataaataaataaataaacaaacaaatcagatacagttgaaactcaaggtgctatcatcccaaggcagattcctctcccactgtgagtctgtgaaattaacaagctatatgctttttaaatacaagtggcaaaggtataggagagacattactgttacaaaaca

SEQ ID NO: 34983 - DNA, 379 bp, Homo sapiens
  misc_feature 31: n = A,T,C or G
catttcactgtttaaaactaggacataggtnaaacaactcaagacattgaacaacatgcagttgaacagagaaaagggaaacaaatgagttcagctctataattaccccctgcttactgcctagaggtagtttctgggttgcagtgcaggcagtgggagcccaaacaaagcctagtagtgtcactgagttctggagactgaaactggagttcagggaggcctagatggctaaaatttgcaggacagaatactagaaagaaaactgtacagggaaaaagttctggaaattgacagaagggttccttggaatttttggctaaattgtgatttgtgcatgtgaggggtgaacccacacaagtttggggttagttgggaaaga

SEQ ID NO: 34984 - DNA, 237 bp, Homo sapiens
  misc_feature 32, 33: n = A,T,C or G
agaagtctccaggaagaaccctaaatttatgnngaccgtggcggagaaagcgctgcaggaataccgcaaaaagcaccgggaggagtgagatgtggatgttgcttttgcacctacgggggcatctgagtccagctccccccaagatgagcttgcagcccccccagagagagctctgcacgtaaccaaattaaccagggcccccagccctccaggcccccaaattccgcccagcctttt

SEQ ID NO: 34985 - DNA, 276 bp, Homo sapiens
  misc_feature 23: n = A,T,C or G
aaatccaaagtgacttaggttancaagttacactaaggaccaggggttggaatcagaatttagtttaagatttgaggaaaagggtaagggttagtttcagttttaggattagagctagaattgggttaggtgaggaagaaagttaaggttaaggctagagttgtctttaagggttagggttaggaccaggttaggtcagggttggattgggtttagattggggccagtgctggtgttagtgatagtgtcaggatggaggttaggtttggagtaagc

SEQ ID NO: 34986 - DNA, 428 bp, Homo sapiens
  misc_feature 30: n = A,T,C or G
gggacatccagcaaatgccccgagccattnaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtac

SEQ ID NO: 34987 - DNA, 155 bp, Homo sapiens
  misc_feature 6, 7: n = A,T,C or G
ataatnnacaggattattggaaatttgttataatgaatgaaacattttgtcatataagattcatatttacttcttatacatttgataaagtaaggcatggttgtggttaatctggtttatttttgttccacaagttaaataaatcataaaacttg

SEQ ID NO: 34988 - DNA, 182 bp, Homo sapiens
aatgctttgtcaaattaagaaagttaaagtgcaataatgtttgaagacaataagtggtggtatatcttgtttctaataagataaacttttttgtctttgctttatcttattagggagttgtatgtcagtgtataaaacatactgtgtggtataacaggcttaataaattctttaaaaggaga

SEQ ID NO: 34989 - DNA, 296 bp, Homo sapiens
gatctcggctcactgcaacctccacctccggtgttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctg

SEQ ID NO: 34990 - DNA, 405 bp, Homo sapiens
  misc_feature 7, 32: n = A,T,C or G
aaatganggctgcacattgcctgttctgcttngaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtat

SEQ ID NO: 34991 - DNA, 111 bp, Homo sapiens
  misc_feature 110: n = A,T,C or G
actgaggaagctaaggtaggaggattacttgagtctggaaggcagaggttgcagtgaactgagatggtgccactgcactgtagcctgggcaacagagtgagaccctgtcnc

SEQ ID NO: 34992 - DNA, 435 bp, Homo sapiens
  misc_feature 20, 32: n = A,T,C or G
agaggcaagagacaaacagnaaacctcaattnttgtttcaggtatacccaggagtaccatctgtaccataaactacaactcaactgttgaaaatcataacttccatcaaaattctaacagctgtgtttcccagtgtcttttatttttttaaagcaggcaagcatcgattttttaaaatttaaaaataacactccttaatattccacactttttcccatttattaactttaaagcatggttcaaagaacaatcacataagacctcttttaaaactgaaagctaagtatgacttatcatggataccctatctcacactgggctctttggatgagcaatttcttagtccttgggacaatctgtatgatgggaaaatgtttttgatagaatgaatgtgaatttctacacttccaaataaagcacataataattttatgc

SEQ ID NO: 34993 - DNA, 490 bp, Homo sapiens
  misc_feature 28, 30: n = A,T,C or G
agatgccctgctggcattcgaggccctntngtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcacctt

SEQ ID NO: 34994 - DNA, 415 bp, Homo sapiens
  misc_feature 23, 31: n = A,T,C or G
aagcccggactaagcagcccagnaagcccantaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctcccccttcttacaccgtgaggccaagatcccctcagaaggcaggagtgctgccctctcccatggtgcccgtgcctctgtgctgtgtatgtgaaccacccatgtgagggaataaacctggcactagc

SEQ ID NO: 34995 - DNA, 150 bp, Homo sapiens
  misc_feature 7, 31: n = A,T,C or G
gaatggnaatccttgctgcactgttgcagtnattctgaaaggacctttccctgtacttacctttcaacatgcttcaatcttatcaacgctacattttgtatttttcaaacaagtataaattctgcaataaagagatgtagtttttttttc

SEQ ID NO: 34996 - DNA, 296 bp, Homo sapiens
cttaatccagtcaatcattgatggacatttgggttggttccaagtctttgctattgtgaatagtgctgcaataaacatacgtgtgtctttatagtagcatgatttataatcctttgggtatatacccagtaatgggatcactgggtcaaatggtatttctagttctggatccttgaggaatccaaacatggcaattctcttaactgaaaacaagacaatcagagaaagacatcttaaaaatattatgatgtatttgcttccatgaaagccaggaaattaaaattataacaaattat

SEQ ID NO: 34997 - DNA, 242 bp, Homo sapiens
  misc_feature 31: n = A,T,C or G
caccctctaaataccacgatcaaaaggactngcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 34998 - DNA, 353 bp, Homo sapiens
  misc_feature 6, 19: n = A,T,C or G
ctatgnaaggagacttagnagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctga

SEQ ID NO: 34999 - DNA, 323 bp, Homo sapiens
  misc_feature 6, 29: n = A,T,C or G
gttacnaatgtgttatttttattctgaantaaattcatgctggccaagcacagtggctcacgcctctaattccaacactttgggaggccaaggcaggtggatcacttgaggtcaggagttcaagaccagcctggccaacatggcgaaaccccctctctactaaaaatacaaaaattagccaggtgtgatggcgcacacctataatcccagctgctctggaggctgaggcaggagaatcgcttgaacctgggaggtggaggttgcagtgagccgacatcgcaccactgcactccagcctgggtgacagagtgagactctctctc

SEQ ID NO: 35000 - DNA, 351 bp, Homo sapiens
  misc_feature 28, 43, 152, 239, 295, 300: n = A,T,C or G
tatggccggaagattgaatggtcacagnaatcggaggacattnaagaaaaaggaaacttcggtggttctgcagcagacatgggctaggtcatatgtggtttctatgagttcgtgtctcaaaaaaaaaaggagggggggcatctgtccccggnggagctcacctatttggaatatggggcatttgttttttccactgcaatgatttcagtctggtttcatcatgttggaattcgatcacnccattttcaaacaatgttaacatagtccagcttttgtttttctcatctcttctganagganactcactgtttctgtctgaggaagctcataccctcggcaaaacatcaggac

SEQ ID NO: 35001 - DNA, 316 bp, Homo sapiens
  misc_feature 2, 10, 18, 19, 21, 72, 73: n = A,T,C or G
anaaaaaggnaccctggnngngaaaatacatgaagataaatcatgaaggccactatcattcctccttctgcnngcgcaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaac

SEQ ID NO: 35002 - DNA, 411 bp, Homo sapiens
  misc_feature 31, 32: n = A,T,C or G
gaggtcttttgtgacttgcttctttcacttnncataatgttttcaagtctcattcctgttgtagcatatatcagatttcattttttaggaccgaataatattccattatatgaatataccacattttgctcatttattcatcagttgatagacacttgcgttgtttcactttttggctattttgaaatgtgctgcaatgaacatttatgcaaaagattttgtgtgtgcatatattttcctttcttctgggtatattcctagtagtggaattgctgggacaaatggtagctctaagtttaaccttttggttattttccaatgtatctgcattctcatgtttcttacagcagaaagttattctcttgaatggctgcatcattattgatgtagtcaaggtgtattttttaagtg

SEQ ID NO: 35003 - DNA, 403 bp, Homo sapiens
  misc_feature 6, 13, 33: n = A,T,C or G
ggcagnatccagnaatggatgtcctctttgttnccatctttgctgtgccacttatcctgggacaagaatatgaggatgaagaaagactgggagaggatgaatattatcaggtggtctattattatacagtcacccccagttatgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgttagaaggtggaagaaggctgctatgactctttggatgggagtctggcaaga

SEQ ID NO: 35004 - DNA, 143 bp, Homo sapiens
  misc_feature 31: n = A,T,C or G
aactctttccctgttcttaacaaaccaaaanttgatggtctctcaagttttccataaatgagttgatcagagacctatgcagtgcttggcaaataccacctgagctgccagtactggtgggatttcacataagcctctttttt

SEQ ID NO: 35005 - DNA, 257 bp, Homo sapiens
tactttttgaagagcattaagttctggtctgtccatttccggaaattctgagctacgttattcatctctgttgttggctctataatgtatgtatctgtttgctgctattcataataacaaaggtcttagcgaagacctagcaatcttagggtaataggaagacagaggaatttcatattggaatttttaacttgcagatcacaacttgttagtgttttatgaaatcagtgtagtgggtcaaaaccactatagttttt

SEQ ID NO: 35006 - DNA, 489 bp, Homo sapiens
  misc_feature 30: n = A,T,C or G
atacacatgtggaaaatgcaactatttttngacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtggtcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcct

SEQ ID NO: 35007 - DNA, 426 bp, Homo sapiens
  misc_feature 6: n = A,T,C or G
cacttnacaatggtgaacctgtttgttgattacccatattgtggtagagccagcatcatggtgaacagaacaggtgctctacatatgctcaggtgggttctctatgacccagaacagcagctggccctttcaaggaagtggtctttgatttcagttcttagagcaagatctgtaggaaagaaacatgatcagccgggtgcagtagctcaagcctgtaatcctagcactttgggaggccgaggcaggtggatcacctgaggtaaggagtttgagacgagcctggccaacatggtgaaaccttgtctctactaaaaatacaaaaattagccgggcgtggcagcatgcacttgtaatcccagatgcttgggaggctgagagaggaagaattgcttgaacccaggaggcggaggttgaagtgagccaaga

SEQ ID NO: 35008 - DNA, 324 bp, Homo sapiens
  misc_feature 33, 47: n = A,T,C or G
acagtacaacaaccccatagtgaggaaaaagtntcaactgacccagnaaatgatagaaatgatagaattagcttagaaaaggacattaaagcagttttatctatattttatggagaagctaaaagacacattaaacaatctgtgtagacacatggaatataaacccaaagcaaactcctagagataaaaactgcagtgtctgaattgaaaagtacactagatgggattaataacagactaaacagaaggaaagattagtaaatttggaaatacagcaataaaaagctttcaaaaatgaaaaaacagaaaggtgctattaaagct

SEQ ID NO: 35009 - DNA, 222 bp, Homo sapiens
gggactgcatgctactgtctagagcttgtctcaatggatctagaacttcattgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaacc

SEQ ID NO: 35010 - DNA, 333 bp, Homo sapiens
gatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatg

SEQ ID NO: 35011 - DNA, 288 bp, Homo sapiens
aagaaacaaagcaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttt

SEQ ID NO: 35012 - DNA, 117 bp, Homo sapiens
ggaattaacaatgtaaccatatggaagcaactttttttggtgtctcaaaggagtaactgcagcttggtttgaaatttgtactgtttctatcataaataaagttatggcttcttgtcg

SEQ ID NO: 35013 - DNA, 270 bp, Homo sapiens
gctttcacattcgggaagcgtcgggattaggtgaaagaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattc

SEQ ID NO: 35014 - DNA, 382 bp, Homo sapiens
ggtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatact

SEQ ID NO: 35015 - DNA, 466 bp, Homo sapiens
ctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttg

SEQ ID NO: 35016 - DNA, 472 bp, Homo sapiens
tagaatgctaatcattatagaaaaaataatttttcaatgctgtaaaagtggtagaacattttctttaaaaaaacataaaaataaaaatggtatgaataagatattaacaaagtcaagtttacatatttttatctattatatatacatataaatttatatatacatgcacatatatatttatatacacatatgtacagatataaatttgtattatatatcatatataaatatatgacgaatagtttttgaattactaactgaattcagcaaagactgatgaataaagtttgaaatgaaacacaagtaagtaataagtaatatttctcttatcttactgtggtttcttatacagatcaagctaagatgtaactaagtgtctatttaaagatgataataacataaagttcattacttgggtataaacacagctgaggtaggtgctgaggataggaaatggaaagagcgaccatcc

SEQ ID NO: 35017 - DNA, 467 bp, Homo sapiens
  misc_feature 6, 15, 22, 32, 79, 82, 88, 141, 188: n = A,T,C or G
gaaggntttctgccncatggcngactggctantacttgcgtctaccccaatccagcaaacgttcccaagaagaactggnggngcagcnagagcaaggagaagaaacacatctggtttggagaaaccatcaatggtggcttncatttcagctatggagatgacaatctggctcccaacactgccaacgnccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgc

SEQ ID NO: 35018 - DNA, 467 bp, Homo sapiens
accgtaagcgaccggaaaccaaatgcttacaaataacaaaatcaggaggtgtttgcttacaattttatttaaatggaggaacatttttgttttactacattaactccctagttgtctaccattaattttcataaacatgggcagccgcttgtgcacaaaaagtaggaaggtctccaactcaagcttctccacactttccttctctaggcacaggggcactgatgtagaagatgctggatgtttatacttagaatccatactatctttcaatgaatacgttaatgatgtttacataaaatgtatgacttacgtatgcgaccaaatctagacaaatatgaggaaacatgattattaaacaagataaacctagatccaaaaaagaaatggatgagagatagatacatggctgagcatagtttaggtgtattttggccaagctttcctttatggatggtatagaactccat

SEQ ID NO: 35019 - DNA, 473 bp, Homo sapiens
gagggcagggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaagccccctgtcactatgaggggaaatattttaccctgggtgagtcttggctccgcaaggactgtttccattgcacctgtctgcatcctgttggcgtggactgctgtgacacgtcccagcatcccatcgacttcccggctgggtgtgaggtacgtcaggaggcaggaacctgccagttctccttggtgcaaaaatctga

SEQ ID NO: 35020 - DNA, 154 bp, Homo sapiens
gagggggtagaaggaaaagctccgtttggtctccattgcctttgaagccatgtcttcaggctatcttagggtcagatagaatgagtgctaggccatctgaaatacctgttgcagatgctcaaccagtaagtataatgcaaatattctaaaacct

SEQ ID NO: 35021 - DNA, 464 bp, Homo sapiens
actctcgtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtagttaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatac

SEQ ID NO: 35022 - DNA, 467 bp, Homo sapiens
aagaaagcagcacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaat

SEQ ID NO: 35023 - DNA, 196 bp, Homo sapiens
  misc_feature 13, 18, 26: n = A,T,C or G
acccagggaaacncggcnttatggcnaggggaacgtgcgtggcgacgtgtcggccatcttgtgttgttgaggctgaggactgactggggttctgagactccctgtcccggaccgcagcgttaaaaggatctgaacaagtctgctcaaatctcctgctgtgaaccagcagaatttttgaacaggtttcttcacatac

SEQ ID NO: 35024 - DNA, 186 bp, Homo sapiens
  misc_feature 10: n = A,T,C or G
gctttttgtntgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatcc

SEQ ID NO: 35025 - DNA, 453 bp, Homo sapiens
ggacagcaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttccgct

SEQ ID NO: 35026 - DNA, 425 bp, Homo sapiens
atcattgtaaaggtctatttctcagaatctggatgggaaaagcagaaaccagttagctctgcaatgcaccaacaacttccatctcaagagttcaagccccattcctgggcgactccatgaagtctgtccttccgtcaggttcccatgccctagtattccccaaaggccaagagaaatgtttttaccaatgtgtcccgcatgatccctgctcagccagccccttgctcagggcactgtccactcctgggttcagtccagctgtttcttaactccagcctcacactatacagatgcattctctccagagccctttgcccccaagtctagactttagttctgacttaattcttcaacacttagtaagaacaggcagaactaaatgtttagcagaatcttggtgaggaattgagaataatcaggaaaac

SEQ ID NO: 35027 - DNA, 467 bp, Homo sapiens
aacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttga

SEQ ID NO: 35028 - DNA, 436 bp, Homo sapiens
  misc_feature 11, 17: n = A,T,C or G
attggcgacancaggtntcgagaaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattat

SEQ ID NO: 35029 - DNA, 108 bp, Homo sapiens
ggatccttttgtagttcatgagcgtgatgattgggtgttcatacgcttgtgtgagatgtgccacccttgaaccttgttacgacgtgggcacgttacccgtctgacctg

SEQ ID NO: 35030 - DNA, 338 bp, Homo sapiens
atatgaagtagatttggttttggctttttaggaggaagggagatggggagacagaatctcactctgttgaccagcccagagtgcagtggcaccatcatggctcacttcagcctcaaactcctgagttcaagcagtccttccgctttggcctccccaagcgctggaattatagatatgagccaccgtgcctgaccatatgaagtgttttaaaactgtgcgtgaaacgtgctatgtatacataaatgttaactatagttatatcttccaaatttcatcattttgttaatcaaattattattacaagtttttatttgttttgttttgagttgtgggggttg

SEQ ID NO: 35031 - DNA, 431 bp, Homo sapiens
  misc_feature 31: n = A,T,C or G
gggagtccatcatgaaggagttccggtcggncgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacgtccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaaga

SEQ ID NO: 35032 - DNA, 135 bp, Homo sapiens
  misc_feature 8, 36: n = A,T,C or G
gtctaacntaaaaagtaaagaaagtaaagtaaaggnttgaaggaaggaaggaaggaaggaaggagggaaaagaaagaaaggaaggaaggaaggaaaagaaagaaagaaaggaaggaaggaaggaaggaaggaagg

SEQ ID NO: 35033 - DNA, 408 bp, Homo sapiens
gtatgtggacttctttcttttgtttatgttcgtaaaagtggagagactctggatatagaaagggtaatagcaaactgatatctccagtacctgtctcctatatgatcaaaaacattaacaatgtgttggttttgtaaaattgctactgttttgttctgaagtgctgtagccattagctggattgtaacagtaatatgacagctgtatagtaaaatactgtctctctttatgataggaaatgaaaaagcatctgttatgaagcctcagtgaactaaaggccattctctgaaaagtcaagacttttgggctttatcagtagataaacatgagccataggttttctagcaatagaatattttaacctatatgaatatatgctttatagggtgagactgctatttaatgaga

SEQ ID NO: 35034 - DNA, 456 bp, Homo sapiens
  misc_feature 7: n = A,T,C or G
caagaanggggcaagtcacatgggcagagtatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataaggtataatgggaaatgtttggccatgcttggttgttgcagttcagacaaatgtaacacacacacacatacacacacacacacacacagagacacatcttaaggggacccacaagtattgccctttaacaagacttcaaagttttctgctgtaaagaaagctgtaatatatagt

SEQ ID NO: 35035 - DNA, 318 bp, Homo sapiens
  misc_feature 317: n = A,T,C or G
aggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatacttaatctttctgaataaatataatgtgtctnt

SEQ ID NO: 35036 - DNA, 473 bp, Homo sapiens
tactatgagatattattctatctgtataagtatatccatagaataaattctgagatatggaatggtggacttattcaaatttcttatataaaccaccaaattatcttttaaagttaattcaccaatatagtctcttatcaacagtgtctgtcactatacatttctccacaatgttgtcaatacttgacaatattcatcttgtatgtttttgttactgtggaaaaaggcttgctgtagttaatttttttattactgtactatttggcaattttaaaaatatttttattgtctatatttctctgtgaattactttatcctttatccatttttaaaaatgggttgtggcttgggtgtggtggcacatgcctgtaatcccagctactcgggaggctgaggcaagagaattgcttgaacccgggaggtggagtttgtggtgagccgagatggcgccattgcactccatcctgggcaac

SEQ ID NO: 35037 - DNA, 475 bp, Homo sapiens
  misc_feature 21, 24, 35: n = A,T,C or G
caaaagcaacaggtaacaagnagnaacttggtctntagtaccacgtccccacataatattccagaggagtgttccgtgggatcttcctaggagttgtttgacaacctttctttactcagataacgttgaaaacactgaattaaatgaagtttttcagtagtgctatgtagacctatgctattttgttttattttatttttgagacagagtctcactatgtcacccaggctgcagtgcagtggcatgaccttggctcactgtagcctccacctcctaggttcaagtgattctcctgcctcagcctcccaagtagctggggctacagacatgtaccaccacaccccgctaatttttgtatttttaataagagatgggggtttcagcatgttggccaggctggtctcaaactcctcacctcaagtgtaatcccagcactttgattggctgaggcagaaggatcacttgaagccaggag

SEQ ID NO: 35038 - DNA, 464 bp, Homo sapiens
  misc_feature 13: n = A,T,C or G
gctctttctggtnaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaggaaagagaagaatgggcaaagaagtaatcatgtagttgaagtctgtggatgcagctgttatgaagatggttaaacttgaaacaaacaattttaagaattatttggtctgaagatgttttactttaaataaatgtctatt

SEQ ID NO: 35039 - DNA, 484 bp, Homo sapiens
  misc_feature 36, 38: n = A,T,C or G
atggccgggattgtaccatatctcatctcccacagnanatgggatatcttgcccacagagatgggatatcttgcatagagctaagtagtgctactgacagagaacctcagtcacttaagtggagacatatgggcagcttaaggtctccttatttgagtagtagacattgccgatggcaaagcattttgggaagaggggtagctcataaatgaggaacttaatctaagaaattatttgttcttcagccctgtggcttcggattgttggtttcttcacggttcactttctctcaggctccacccctctctcactgcagagaacttgttgacagcagctctactttttccagtcttgcacaaaggcagatgtctgaaaatttagcttacgcaaaccatctgtgtgcttgactctgttcccacggtgtgttttcctgtactgcccctccccacttttcggtcctttttaaaaactgaaaacacagtat

SEQ ID NO: 35040 - DNA, 479 bp, Homo sapiens
gtattcgttattataggtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttta

SEQ ID NO: 35041 - DNA, 475 bp, Homo sapiens
acactatttcttctgaaaacttattggatgctgtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaag

SEQ ID NO: 35042 - DNA, 465 bp, Homo sapiens
ggggagaagtccacttaaatgcagctcctgggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgag

SEQ ID NO: 35043 - DNA, 100 bp, Homo sapiens
  misc_feature 75: n = A,T,C or G
aaggaaagcagagagaccctcactgctggggagtccctgccacactcagtcccccaccacactgaatctcccctnctcacagttgccatgtagaccccct

SEQ ID NO: 35044 - DNA, 409 bp, Homo sapiens
  misc_feature 38: n = A,T,C or G
atggccgggagtaggaagaattacaatttctttaaatntttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaaaaga

SEQ ID NO: 35045 - DNA, 471 bp, Homo sapiens
  misc_feature 31: n = A,T,C or G
gagaccggaagcgctccgctgtacctggatnctgctcctctgggttgaaacccgggcgccgccaagatgccggcttaccactctcctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacag

SEQ ID NO: 35046 - DNA, 348 bp, Homo sapiens
agaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctctca

SEQ ID NO: 35047 - DNA, 335 bp, Homo sapiens
  misc_feature 7, 23: n = A,T,C or G
ggtgacnacctacgcacacgagnaacatgcctttcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgggt

SEQ ID NO: 35048 - DNA, 432 bp, Homo sapiens
  misc_feature 31: n = A,T,C or G
agaaacatttatatggatacatacatctgcntaggttagggagaaaacggtagccctggcagagaagagctagttagtgtatttcaggatagggccaagggaagctgtcatttctctactaagtctcattgtggaaaagccacaaatgtccctagtacagtaataaggaaaaaaaggctgagcgtggtggctcacacctgtagtcccaggactttcggaaggattgcttgagcccaggagttgcagatcggccaggacaatgtaagaaaaccccatgtattagaaaaaaagaattagccaggcgtgatggtgtgggtctatagtctcagcttgggaggctgaggtggcaggatcgcatatagcccaggagttcgaggctgcagtgagccatgatcgcatcactgcaccctagtctgggcaacagagtcttga

SEQ ID NO: 35049 - DNA, 419 bp, Homo sapiens
gggaatttgttaggaaaaggtgagttacatttagaagttaaagtgtttaccaacattgatttagtttagttccttttgagaatctggcttagaaggacaagataagttatggttgcattaatatagtagggcacatgaaatgaaaccaagtactgtttgctttcctttgtttcagatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagct

SEQ ID NO: 35050 - DNA, 396 bp, Homo sapiens
  misc_feature 30: n = A,T,C or G
ggtaaggggtcctccctgcgccacacggcngtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctgctttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaatgtttttaac

SEQ ID NO: 35051 - DNA, 472 bp, Homo sapiens
  misc_feature 31: n = A,T,C or G
acgacacactggcaaatcacttttatccccnaacctcaaaaatggtctcaaggtttccaaatagaggtgtttcttttcattttctagaaaagtgagcatagtggtatgagcccctgaagctgcatccttctggggtaaggcagagccatctcacaaaccacaccacctgatggcatctattacaaatgtcagattttgtaggctgaagtgaccaagaagccattgggaatgagcaaagttttaaattgctggaaggaatcttcagcaaacaggcaaatactttaaaattttaggtgatccatcactgaataatttgaaagatcttcagattcttgtactgtgagtcacttctgtaggcatgaaagagtgagcaatgcaggcataacattaaaaggagactgataaggaaataaaaatgaagaacagaaatagctccaaagattagatgtaagcccttggggttgggattatc

SEQ ID NO: 35052 - DNA, 403 bp, Homo sapiens
acttacaaaaggaacccggctcttaggatagaaacaattgtcatacttcaccagctctaggctgagtttctttagcaagacatattcctttagatattcataagagttcttttaaactgtttctgatataaatggtaatgaagaaaatattttaaaatattaacaggaagtaaattgcacatttcaagtgatgtgttgtatagtaggtaatgcaatataagaataagcagtaattttaaaagtcacagaactgtagaatgagaaggtgccttaggtattgatattattaagtcaaacaagagtggcttcagctcctgcctctttaatatcaaggccttggatgaaatttttaaaaggaggtgaggacatccatttaggttttcaagtgaacaaaaagcagtat

SEQ ID NO: 35053 - DNA, 370 bp, Homo sapiens
  misc_feature 6, 28, 30: n = A,T,C or G
catcangagagagaaagaggcctagccnanttctcccctcatcacgtcctactcccctcccctatacagctgagtcctaagagtccctggatccctcctttctccagtgactataagtatcccataacagagtcctcttcccacattatattgcttaagaattcagtcttgccttcctggaaacacaaatcattttagcatcactcattgactctgtattttgcatatgaaataactttttaaaaatccaaccaaaaaggaaagtgagaaaacgctatccacgctaaataaggaaaaatcatagcagaatactgaatcatctaccaggtggccaaaattccgacttcagaactcaaaggactagttttcg

SEQ ID NO: 35054 - DNA, 394 bp, Homo sapiens
  misc_feature 6, 30: n = A,T,C or G
aagggnagtttatttttgttataaaaacantattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcctttctgaatacatataaagtttaagatctttggagttttaagtatataatgtttttctg

SEQ ID NO: 35055 - DNA, 426 bp, Homo sapiens
aatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaata

SEQ ID NO: 35056 - DNA, 264 bp, Homo sapiens
ggagttcttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagaga

SEQ ID NO: 35057 - DNA, 211 bp, Homo sapiens
ggagtttacgcgcgtatgctttgcccgctatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctacttt

SEQ ID NO: 35058 - DNA, 235 bp, Homo sapiens
  misc_feature 208, 211: n = A,T,C or G
cagcagggttcgtaaaccgatgctgcagtcaataaaggttattaacagcatattggatgttgtgatgagattagaagaaagcacttgaaacatggcctactacatagtgagtacaattaaatgtttctaattaaaaattttagagaggcgccaagttcttaagttcctactcagttcatcagcaagcatgtattgatttgcttgtggntgncatccttatcattatggtaatatg

SEQ ID NO: 35059 - DNA, 186 bp, Homo sapiens
  misc_feature 127, 162: n = A,T,C or G
ggactggggtgcagacggagtgtggaaaacgcataccttgaaatgaagcatccagcagatggggtgagtggatacagctcaggagattctcccaggaatagcagggaggcgtaaagagagacaacgnacagagatagatgaatggaaatggggaagggaggngtgcattcacatccatctaactgc

SEQ ID NO: 35060 - DNA, 164 bp, Homo sapiens
agaggtatccgtgttggctggattttgaaaatccggaattatgttataacgtgcctgtattaaaaaggatgtggtatgaggatccatttcataaagtatgatttgcccaaacctgtaccatttccgtatttctgctgtagaagtagaaataaattttcttaaat

SEQ ID NO: 35061 - DNA, 238 bp, Homo sapiens
aatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccccccgctcccccaaaaatttgaatttttttttcaacactcttacacctgttatg

SEQ ID NO: 35062 - DNA, 341 bp, Homo sapiens
catgatttaatatgtaaagaagctacacaaggctatgcataacaggagcatgggccttgggagccatttggaggctggctacctcatgtactatctttaaaatatggacaaattaaataaaagaaagtctggatgaaatattaatgtgagattggtatgaagcaaggaagtgtagttaattatttgtataatgcttggatccattctgaaaaaatgcagtatcacttctatggaaaataagcttatagatctcagtaatattcaaggatcttattcttagttttttttgatttgtgtctattggctttgttgttagtgattcaatgagtgaaacaataaac

SEQ ID NO: 35063 - DNA, 451 bp, Homo sapiens
tgagtaagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaatttttctaagttatcaaaacaacctaatttcttttccaacaaggagaacttaatggcgtgaaggattgtgtga

SEQ ID NO: 35064 - DNA, 144 bp, Homo sapiens
gatttcccctttatgttttaatatcctaggcatctgctgtaataatattttagaaaatgtttggaatttaagaaataacttgtgttactaatttgtataacccatatctgtgcaatggaatataaatatcacaaagttgtttgt

SEQ ID NO: 35065 - DNA, 241 bp, Homo sapiens
  misc_feature 178, 181: n = A,T,C or G
aatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggngtnaccctgggatgggaaatcctatgatccacagaccgatgtctgacccaggagtattttcac

SEQ ID NO: 35066 - DNA, 190 bp, Homo sapiens
tgagcatatagtgagacccccatccctacaaaaaatgtaaaaattagctaggtgtggtgacacacacctatcagttacttcagggggccgatgtgggagaatcgcttgatcttgggaggtcgaggctgcagtgagctatgatcatgccactgtactccagcctgggcaacaaagtaagacactgtcccga

SEQ ID NO: 35067 - DNA, 351 bp, Homo sapiens
ataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggtcttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggac

SEQ ID NO: 35068 - DNA, 108 bp, Homo sapiens
  misc_feature 6, 22: n = A,T,C or G
aggagngatccatataaaccanctggctagtagcatgtgtgctgtgtgtggctgcaggtgttattagtaacatctgtgtgcccttcagagcgtgcaccacacttcaca

SEQ ID NO: 35069 - DNA, 268 bp, Homo sapiens
  misc_feature 244: n = A,T,C or G
ggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctgggnacaatgtgggcttcaatgtcaaga

SEQ ID NO: 35070 - DNA, 175 bp, Homo sapiens
ggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttc

SEQ ID NO: 35071 - DNA, 344 bp, Homo sapiens
  misc_feature 4, 65, 145: n = A,T,C or G
gggncctggcccttccgcagtcttgtacatttgccctgccgtcagagttggaacgtagttatcancgattcacagctttctacgccagccgccacagtggccgaaaattgacgtggctatatcagttgtctaaaggagaattggnaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaat

SEQ ID NO: 35072 - DNA, 202 bp, Homo sapiens
aagaccaacctggtcaacatggtgaaaccctatctctacaaaaatacaaaaattagccaggcatgatggcaggtgcctgtaatcccagctacttgggaggctgaggtgggagaaatgcttgaatccaggagacggaggttgcatgtgagcagagatcacgccactgcactccagcctgggcgacagagcaagacgccatctc

SEQ ID NO: 35073 - DNA, 315 bp, Homo sapiens
  misc_feature 306: n = A,T,C or G
aatataaatttaaaataattataccttattacctctcatgggtcttgaaatgtaggtgctatgttctgctttctgccgaggcaagggaataatacagaaaccagtaataaattataactttaggctgcagttggtaggctggaggaattgctatttaagtggaaagtgcttgaacagccaaatgagcacctgtcatgtttattttcacttcgaaaagtagaaacatgacagtatagtttccactgcctatccaatatgaacttctggcattcttgttatcttctcaggaactgcactgtttgcttnttgtgttca

SEQ ID NO: 35074 - DNA, 410 bp, Homo sapiens
ctctcatgctctatatcctttataaaaattaaaagaagaagaaggggaaaaaaatcctcattaatgtatgctggcaaaacaatggcagtcattttcctggctgaaaactaaattattgtgcattgtagtgtgcatgtctatgataagtagattactatagatcattccgagaggaggtagaaggaagattgcactaacattagcttctctggtatttgcaggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatg

SEQ ID NO: 35075 - DNA, 426 bp, Homo sapiens
  misc_feature 25: n = A,T,C or G
ggttgtccagatagaatcttagttnactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcac

SEQ ID NO: 35076 - DNA, 121 bp, Homo sapiens
gtggggagggggtctctcccgagagtttctgtttttactcaaaataatgttattctcagatgcttgatgcactgttggaaatgtgattaatttaatcatgcagataaaccatttaaatgtc

SEQ ID NO: 35077 - DNA, 157 bp, Homo sapiens
  misc_feature 127: n = A,T,C or G
tgtatcgtgtggcgtattttttaaaaaatttgatttagcattcatattttccatcttattcccaattaaaagtatgcagattatttgcccaaatcttcttcagattcagcatttgttctttgccagnctcattttcatcttcttccatgggtccaca

SEQ ID NO: 35078 - DNA, 317 bp, Homo sapiens
attcctaatttacagacaagacagtccctacaatggaattgtctaacccaaaatgttaactgttcaaaggctaagaaatcttgctctagattaaaaacattgctgctgaaactatggttcttgagccaacagtattggcctccttgacagcttattagaaatatagactcttaggttctattttagacctactacaatgagaatttgaacttaacaggaatcccatctgatttgcatatgcattaatgtttggaaagcactggatgcaaataatactgttttcttaaaagttatcttttggaatggttttagactta

SEQ ID NO: 35079 - DNA, 183 bp, Homo sapiens
gtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatgggca

SEQ ID NO: 35080 - DNA, 308 bp, Homo sapiens
aaatacaaaaattagccgacgtggtggcacacacctgtaatcccagctacttgggaagctgaggcaggagaatcacttgaacccaggaggcggaggttgcagtgagccaagatcgtgccactgcactgtagcctaggccacagagggagactctgtatcaataaataaataaataaaagttttcctgaggccaggcatggtggctcacacctgtaatcccagcactttggggggctgaaaagggaggattgcttgaggccaggaattcaaggccagcctggtcaacataatgagaccccatctgcact

SEQ ID NO: 35081 - DNA, 425 bp, Homo sapiens
aatctgattttgtttggatatttatcttgtacccgctgctaaacacactgcaggagggactctgaaacctcaaactgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctcattgtatctga

SEQ ID NO: 35082 - DNA, 229 bp, Homo sapiens
  misc_feature 8: n = A,T,C or G
ggacagtnacaatatgtacttaaaagttgcactattgcaaaacgggtgtattatccaggtactcgtacactatttttttgtactgctggtcctgtaccagaaacattttcctttattgttacttgctttttaaactttgtttagccacttaaaatctgcttatggcacaatttgcctcaaaatccattccaagttgtatatttgttttccaataaaaaaattacaattt

SEQ ID NO: 35083 - DNA, 187 bp, Homo sapiens
ggaatccctgcggtcccagcgtcgctccggacgctgccaacctgttctccaccgtcgctcgacttccacctctaagactcccacgaaactcaggttgaataattcatcaaattacacaactgaactcaagacatggctgcccagggtgtcacaaaggtggcgctgaatgtttcctgtgccaatcttt

SEQ ID NO: 35084 - DNA, 238 bp, Homo sapiens
  misc_feature 233: n = A,T,C or G
ggctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagngacga

SEQ ID NO: 35085 - DNA, 344 bp, Homo sapiens
attctttgtgccctctcaagcttcacctttggccctggcctacagggattccgggttcaggaaagactttgaatctgcagccacatgaaaatacatggcactgctgtggacccactttttaaggaggggggggcggggaaagcgtagaaaagatttgacagcttgaaactacatcagccagtttgtagaggttttggccactcttctagtttccatacacatgatccgtgatggatttggaggggcatgggaaagaggacaaagccagaggctcctcattagtcttgggaattcaaggagacttcagtttggtagctgcacttggagagattgtgtgtgtgcgc

SEQ ID NO: 35086 - DNA, 340 bp, Homo sapiens
gaatttcaacatcactattgagaaaagaatataaatttgaatgaaaatgaaactctatctttctatatcacattgcataggtgtaggctagtgagtactttgatgtaaattgctgtatcttttgaggcatctatttggcaatatagatcagaattttaaatcagcatactttgtttgccagaaatctatcaggaccacttgtagtaattttgttaaaaggaatatcaaacacttggatgttcatcacagtattgattgtattagaggaaggaaagggagaaagggaggagaatggaagagagaaagggagggaggaagattggaagcaattgagatatgt

SEQ ID NO: 35087 - DNA, 316 bp, Homo sapiens
tacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattctt

SEQ ID NO: 35088 - DNA, 172 bp, Homo sapiens
  misc_feature 103, 112, 135, 160, 170: n = A,T,C or G
aggagctggtttttttaaaagattaacaaaatagatagacagctagccagactaatagagaaggaaagagagaagaatcaaatagatacaataaaaaatgatnaaggggatntcaccactgatcccacagaaatncaaactaccatcagagaatactatnaacacctctntg

SEQ ID NO: 35089 - DNA, 165 bp, Homo sapiens
agccggcatggtggcaggtgcctgtagtcccagctactcaggtggctgaggcacaagaatcacttgaatccgggagacggaggttggagtgagctgagattgtgccactgcactctagcctgggcaacagagtaagaccctgtctcaaaaaataaataaaatgtc

SEQ ID NO: 35090 - DNA, 394 bp, Homo sapiens
  misc_feature 286, 309, 351, 354, 364: n = A,T,C or G
acataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtgggngcatgtgcctataggcccagctncttgggaggtggaggtggtaggattataaatagagactgggntgnggactggggnggtggggtgggggggctgtgggggggtggg

SEQ ID NO: 35091 - DNA, 286 bp, Homo sapiens
  misc_feature 252: n = A,T,C or G
tatggccgggagcagtggctctgccctgtaatcctagcactctgggaagcctaggcaggcagattgcttgaggccaggaatctgtgactagcctaggcaatatggctaaaccctgtctctacaaaaaaacacaaaaattagctgggtgtggtggcatgcacctcaagtcccagctacttgggagactgagctgggaatatcgctggagcctgagaagtcgaggctacagtgagctgtgattgtgccactgcnctccagcctgggcgacagagcaagaccctgcctc

SEQ ID NO: 35092 - DNA, 151 bp, Homo sapiens
tagttattcattctttactcaaatatagttttaaggcccagtctttgcctagcacacaattgaaatgttgaccataatacccccttgatatctttctcatgctttattctctgtgaagaatagcagcgtgcacctttgtttattcctcatg

SEQ ID NO: 35093 - DNA, 139 bp, Homo sapiens
gggacagccccgctcccagtatgtaaagaacgcgacttccacaaacctggattttttatgtacaaccctgaccctgaccgtttgctatattcctttttctatgaaataatgtgaatgataataaaacagctttgacttg

SEQ ID NO: 35094 - DNA, 146 bp, Homo sapiens
aggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctt

SEQ ID NO: 35095 - DNA, 201 bp, Homo sapiens
gctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgac

SEQ ID NO: 35096 - DNA, 244 bp, Homo sapiens
  misc_feature 240: n = A,T,C or G
gaaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatanccag

SEQ ID NO: 35097 - DNA, 231 bp, Homo sapiens
  misc_feature 207, 215, 216: n = A,T,C or G
aggccaggggctgacagccaatgtcaggaccctcagcggtggagcctgctggggggacccagctgctcttggacaagtggctgagctcctatctggcctcctcttttttttttcaagtaatttgtgtgtatttctaactgattgtattgaaaaaattcctagtatttcagtaaaaatgcctgttgtgagatgaacctcctgtaactnctatctgnncttttttgaggctca

SEQ ID NO: 35098 - DNA, 381 bp, Homo sapiens
  misc_feature 280, 340: n = A,T,C or G
gtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcnagagcaattactactcgttctgggcagaccttatccaaagtctggtacaactgtccttanactgatgagcaaaggaggagtcaactaatgaagaaatgaat

SEQ ID NO: 35099 - DNA, 108 bp, Homo sapiens
aaggaggctgaagtggaaggatcacttgagtccaggagttcgaggctccagtgagccataattacacactgcagtccagcctaggcaacagatcgagactctctctcg

SEQ ID NO: 35100 - DNA, 200 bp, Homo sapiens
aagaccacctggtcaacatggtgaaaccctatctctacaaaaatacaaaaattagccaggcatgatggcaggtgcctgtaatcccagctacttgggaggctgaggtgggagaaatgcttgaatccaggagacggaggttgcagtgagcagagatcacgccactgcactccagcctgggcgacagagcaagacgccatctc

SEQ ID NO: 35101 - DNA, 497 bp, Homo sapiens
  misc_feature 12, 13: n = A,T,C or G
atggcccgggannttattatttgatttatttgtgtctattttgctctgtggcttggaccccagaaacacttgtataataggtgaaatgaacaaagaatgagctgccagaacatctgagagctgtaaagttaaaattatttggacccaaagaagcatagtctgacgttgttcagttcacacaaaattttgtctgaaaagccaacttttttctttcccttttaaattatgctgaacatttagggccagtatgtgtaactgacatgctgggacagttgtactcacttttgctggcctgtaggactgtgacatagggagaacactaaagtgtgtcctccgggcctcgggtctcagtcctggagctatctacagtatgttaccagcgagtaagaataatagcttctacttgcttttccctacagagttcaggagttttaaaacgtcatcttagtctcattatgaccttcacatgggctatgacaataatttcctgtagtcag

SEQ ID NO: 35102 - DNA, 470 bp, Homo sapiens
  misc_feature 13: n = A,T,C or G
gaagaactctttnaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggacctgaagaataagtactaccaggtgccaaggaaggggatacaggccaaagaggtgctgaaaaaatatttggagtccaaggaggatgtggcttgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcagg

SEQ ID NO: 35103 - DNA, 126 bp, Homo sapiens
  misc_feature 26: n = A,T,C or G
aggaaagggaattcctagctcaaccnaagtggtaatgaaataacctagcatgtcaagatgaatgttaaagctattgtaatcaagacagtggaagcctgggcaacacagggagaccctgtctctgct

SEQ ID NO: 35104 - DNA, 414 bp, Homo sapiens
  misc_feature 45, 229, 257, 298: n = A,T,C or G
gattcctgaagctggcagcattcgggccgagatgtctcgctccgnggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaatngaaaaaggggagcattcagacttgtctntcagcaaggactggactttctatctcttgtactacactganttcacccccactgaaaaagatgagtatgcctgccgtgtgaaccatgtgactttgtcacagcccaagatagttaagtgggatcgagacatgtaagcagcatcgcggaggtttgaaga

SEQ ID NO: 35105 - DNA, 471 bp, Homo sapiens
  misc_feature 25, 100, 401: n = A,T,C or G
atggcttgagagtaaaactcctagnaaccagttcctgtttctgtaacaagaatgttcctttagagtcaatgagaacacacacaacctacaaattcatgcnggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcaggtgatttttatagcatgcactataaaggcaaagtgaagaagctcaagaaaacatcttcaagtgactattcaattttcgacaactattatattccagaaataactagtgttttactactttcgatcctgtaagacttnaacccatgagatcggacacatatttggactgcgacactgccagtggcttgcattgcctcatgcaaggttc

SEQ ID NO: 35106 - DNA, 473 bp, Homo sapiens
  misc_feature 13, 40, 431, 447: n = A,T,C or G
aacctgccgcagncctgggggtgaaccccagtcccgaagncctactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagngattctaagatttggnttgggatcaataggaaagcatatgca

SEQ ID NO: 35107 - DNA, 159 bp, Homo sapiens
  misc_feature 5, 17, 122, 158: n = A,T,C or G
tcccngggaattcggcnttatggcgggggatacttctctttttttgctgttccaccaaatacaattcaaatgctttttgttttatttttttaccaattccaatttcaaaatgtctcaatggngctataataaataaacttcaacactctttatgatanc

SEQ ID NO: 35108 - DNA, 181 bp, Homo sapiens
  misc_feature 139, 151, 156: n = A,T,C or G
gatcgggaactcctgcttctccttgcctcgaaatggaccccaactgctcctgctcgcctgttggctcctgtgcctgtgccgggctcctgaaatgcaaagagtgcaaatgcccctcctgcaagaagagctgctgctcctnctgccctgtggngtgtncaaagtgtgcccagggttgcatctt

SEQ ID NO: 35109 - DNA, 250 bp, Homo sapiens
catgttctcatttataagtaggagctaaacattgggtacacgtggacataaagaaggaagcaatagacatggtgacctacttgagggtggagagtgggaggaggattaggataaaaaaactgcttatgggtactgtgctcattacttgggtgacgaaataatttgtacaccaaacccccatgacatgcagtttactcatgtaatgagcctgcacatgtacttcctgaacctaacataaaagttggaaaga

SEQ ID NO: 35110 - DNA, 275 bp, Homo sapiens
  misc_feature 10, 148, 150, 245: n = A,T,C or G
tgaggctgtnatgcctgtaatctcaacactttgggaggccaaggtgggcggataacctgaggtcaggatttcgagaccagcctggccaacatggcgaaacaacgtcattactaaaaatacaaaaattagctgggcatggtggcaggtncntgtaatcccagctactcgggaggctgaggcaggagaatctcttgaacccaggaggcagaggttgcagtgagccaagatcacgccattgcactgangcctgggtgacaaaagcaaaactccatctc

SEQ ID NO: 35111 - DNA, 471 bp, Homo sapiens
  misc_feature 470: n = A,T,C or G
gattcttcccctctctaaacccctctctcctcagcgcttcttctttcttggtttgatcctgactgctgtcatggcgtgcccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggggtctgccagcttggggccctccctgtcgccagtgggcacttttttttttccaccctggctccttcana

SEQ ID NO: 35112 - DNA, 471 bp, Homo sapiens
ggtctgcaggatggcacccggacccctggttctccacatacgattctacttgtcaaattgcccaagaaattgctgagaaaattcaacaacgaaatcaatatgaaagaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccaggaggagaccagaggcttgggttttgatgaaatccggcaacagcagcagaaaattatccaagaacaggacgca

SEQ ID NO: 35113 - DNA, 341 bp, Homo sapiens
tagggtagtcatctctctccgctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttagggttgctataccaatggcttattaaatgaaaatggcaca

SEQ ID NO: 35114 - DNA, 497 bp, Homo sapiens
  misc_feature 2, 21: n = A,T,C or G
antggcccggggggaaagagnccgtgatctggcccttcgactcgctatgtccactaacaatatgtcggacccacggaggcccgaacaaagtgctgaggtacaagccccccgccgagccgaatgtaacccggccttggacgacccgacgcccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccag

SEQ ID NO: 35115 - DNA, 287 bp, Homo sapiens
  misc_feature 7, 34: n = A,T,C or G
tcggccntttattggccgggccgcggtggctcancgccctgtaatccccagcactttgggaggcccgaggcaggtggatcacgagctcaggagattgagaccatcctggctaacacagtgaaaccccatctctactaaaaatacaaaaaaaattagccgggcatggttgcaggcccctatagtcccagctattcgggaggctgaggcaggagaatggcctgagcttgcagtgagctgagatcgtaccactgccctccaacctgggcgacagagcgagacaccgtctc

SEQ ID NO: 35116 - DNA, 472 bp, Homo sapiens
  misc_feature 246, 383, 468: n = A,T,C or G
aggcccgatttctgcccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgcttgccgccactttctaatcctcatcatgacaacgtcnggtatggcatttcaaatatagatacaaccattgaaggaacgtcagatgacctgactgttgtagatgcagcttcactaagacgacagataatcaaactaaatagacgtctacaacttctggaagaggagaacaaagancgtgctaaaagagaaatggccatgtattcaattactgtagctttctggctgcttaatagctggctctggtttcgccgctagaggnaaca

SEQ ID NO: 35117 - DNA, 500 bp, Homo sapiens
  misc_feature 2, 3, 34, 43, 50, 79, 103, 122: n = A,T,C or G
cnncggctttctttgtgggttacctggacccccngggcttganccacccnagcccttcttcacggagggcattctttantgttaaaccctaccctttacccanttgccgcctgtgtaacacnagatttcctccctcttgcgcttatgtggacatttgccatccccatgcaacaacaagggagctcactcagtgggtttaatgtggtggatgctggctcgggaagttctgcgcatgcgtggcaccatttcccgtgaacacccatgggaggtcatgcctgatctgtacttctacagagaccctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaaggtgccctctgtgcctattcagcaattccctactgaagactggagcgctcagcctgccacg

SEQ ID NO: 35118 - DNA, 263 bp, Homo sapiens
  misc_feature 8, 31, 33, 34, 36, 42, 61: n = A,T,C or G
tccggccntttaatgggccggggtaaaaaanannanaataanggcaggttttccaggtccnccggaaaaggtttggccctgacgcctggagtgcggtgatgaaccttacgtgacaatgattgtattcctcagtagcactttaaacgcccgaagacagccctgcagcaagccctgcacacgggcttgggtgggttcctttggagaagatgtggctggaacacaaacaatctttgaaagaaataaatgtgcacacagaacactac

SEQ ID NO: 35119 - DNA, 403 bp, Homo sapiens
  misc_feature 8, 14, 28, 29, 62, 88: n = A,T,C or G
tccggccntttttngccggggggggaanncggcggcagaagcccatgtcccggcccgcgaangtggcaagaagaagcccacctgaaanagccccaagaagcaggccaaggagatggaccgaggaagataaggctttcaagccagaaaccaaaaagaggagcagaagaaactcgaggagcctaaaagccgaaggccgcggggaaggggcccttggcccacaggtggaattaagaaatctggcaaaaagtaagctgttccttgtgccctgaggagatggtgaccctttatttcatctgtatttaaacctctctattccctgccataacatcttttgccacgtatagctggaattaaaggtgttgtctttgggagcctgttgtacattttaagaataaactttttt

SEQ ID NO: 35120 - DNA, 372 bp, Homo sapiens
  misc_feature 2, 5, 8, 10, 14, 19, 21, 22, 23, 25, 26, 30, 31, 34, 44,46, 49, 53, 62, 64, 72, 89, 113: n = A,T,C or G
gntcngcncngganctacnannnanntccnnggnggcatatatntnccnctcngggttcccncntcgttagncgtatatggcctaaganagccaatacaagaatccaatgatncaaacaaaggcaaagtaaactttaagggtgcagacatgaatggattacccaacaaaaggaccaacagaaatctgtgatgaaaaagaaaagactaaagaaattttcctaaaggaccccatcatttaaaaaatggacctgataatatgaagcatcttccttgtaattgtctctgacctttttatctgagaccggaattcaggattaggagtctagaatatttacctgatactaatcaggaaatatatgatatcccgtattt

SEQ ID NO: 35121 - DNA, 463 bp, Homo sapiens
atttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaacc

SEQ ID NO: 35122 - DNA, 288 bp, Homo sapiens
  misc_feature 8, 16, 31, 35, 49, 67: n = A,T,C or G
ccgggaanttcggccntttatggcccggganctcnggctcttctagccntcctgtctcatctaaganagaaaaaaagctgtgaagtgcttgtgaaggttacaggctggagacacaggcacactaaaaaattgagacttcatcataggattagagaatgcctccccttccacaccttgctgctacatcaacagagcttcagtataataatcgtggattatagctgaaagacctgcaaggatcagactctatttaaggaggtttttttgttgctgttttgttttgatttg

SEQ ID NO: 35123 - DNA, 436 bp, Homo sapiens
  misc_feature 38: n = A,T,C or G
ctcccacttatttggaaaaaaaatgtcttgtgcaagcnacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaatggaagatgctgtgggattacatcttgtgtgtgtcagagaaactgcagagaacctggaga

SEQ ID NO: 35124 - DNA, 459 bp, Homo sapiens
  misc_feature 6, 11, 23, 24, 31, 32, 36, 39, 60, 68, 71, 73, 90, 112, 372: n = A,T,C or G
cggggnaggtntccgtttttccnnttgttcnngaangancgttggtgttgaggttagccntaccgtantcnanggaccagtaacctaccnctggctccccgaagttttgccnaaaaccctcggatgcgtggcccttcctggccaggccgtctgcgaaaatcattattggctgtagcattccgtgctatccctgggggttgcagctttgtataagtttcgtgtggctgatcaaagaaagaaggcatacgcagatttctacagaaactacgatgtcatgaaagattttgagggagatgaaggaaggctggtatcctttcagagtgtaaagtaatcttggaatataaaagaatttcttcaggttgaattccttanaagtttgtcactgacttgtgttcctgaactatgacacatgaatatgtgggctaagaaatagttcctcttgataaataaacaattaac

SEQ ID NO: 35125 - DNA, 372 bp, Homo sapiens
gcttttcgatccgcctctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaaggaagaagtcttacaccactcccaagaagaataagcacaagagaaagaaggttaagctggctgtcctgaaatattataagggggggatgaga

SEQ ID NO: 35126 - DNA, 469 bp, Homo sapiens
ggcagcccagatgagtaggtttccatccagctcggcacaccccctccaccaagggacaaccaaagtgcttcattaaatgggtcctgctccccgtgccacccaactgggcgagaccctcttaacgggttgtcagacaccctatataggaatgtttctattagcatcaggtaggtgccccttgaggtcagatatctcagagggaggagcaggtacccatctttgccgttctccagcctcctcaagttcactccaggtgcaggagtgaaacagataaatagggcctgaagtaaatgcccagcaaaccacagcagccatacagaagagggacctgaccattgaaagaaaaaacaagcaaacaaatagaaagcaacaacagcatcaacaaaaatgttcccgcaaaaacctcctccaagggtcagcagcctcaaagattgacactagacaaactcatgaagatgaagaaaagaat

SEQ ID NO: 35127 - DNA, 496 bp, Homo sapiens
  misc_feature 2, 15: n = A,T,C or G
cngggaattcggccnttatggcccggggtttagagataaggtgatgtcagagtttaataacaaccttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaac

SEQ ID NO: 35128 - DNA, 337 bp, Homo sapiens
  misc_feature 5, 12, 333: n = A,T,C or G
caccncgggaanttcggccattatggcccggggtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatcttgntttg

SEQ ID NO: 35129 - DNA, 422 bp, Homo sapiens
  misc_feature 8, 16, 33, 39: n = A,T,C or G
ccgggaanttcggccnttatggcccgggagaangaaganccgacatcctgcaccctccacatggtcactaattccctgctgtggggggcacattttggcctgacttggctgacacaatctggggaaaaaagagaagtatgggctgagtactgtggctctcactggttaatcccagcactttaggaggcagcagcaggaagattgcttgagcctaggaattagatcagcctgggcaagatggtgggaccttgtctctacaaaaataaaaataattagctggccataatgccacgtgcctgtagtcccagctacctgggaggtttgaggtgggaaggattgcttgagcccaggagtttgaggttgtagtgagccatgatcatatcactgtgctacagccttggtgacagagaccctgtctctac

SEQ ID NO: 35130 - DNA, 304 bp, Homo sapiens
  misc_feature 6: n = A,T,C or G
tcggcnatttatggcccgggaaagcagtgctctaatgggacaaagtcactgtgtgctcttgctttctctcctggtctttgtgcgtgatagtccctctctctagaaccctcttcctcctcctcattcctctgagctaatgtattcgttcttctgttcagccttgacatcactccctcagtaaatttctgaccattcccaagcctggattagctgtgtcttctgcatgcaccctgtaatctggaatgatcattggtggcactgattacactgctttatcattgcttgctgtttgtaccacctgctc

SEQ ID NO: 35131 - DNA, 472 bp, Homo sapiens
  misc_feature 21, 439, 458: n = A,T,C or G
accttccggtggacccgaagnaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacaggtcaaagggattcaacccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgcccgctagtgattcagggagtggaatcttttgatgaaggaagcagncactaatttgtttgtttgnatttaaactccatt

SEQ ID NO: 35132 - DNA, 225 bp, Homo sapiens
  misc_feature 8, 10, 31, 47, 96: n = A,T,C or G
tccggccntntatggcccgggagtaaaaganctggttaatgataacnaatgcatcgtaaaacccttcagaaggaaaggagaatgttttgtggaccnactttggttttcttttttgcgtgtggcggttttaagttattagtttttaaaatcagtactttttaatggaaacaacttgaccaaaaatttgtcacagaattttgagacccattaaaaaagttaaatgag

SEQ ID NO: 35133 - DNA, 456 bp, Homo sapiens
  misc_feature 8, 31: n = A,T,C or G
tccggccntttatggcccggggagtatagancttttgtaggtgtttagccctgaatctgtagtgacccggaatttcaacaaatgaggtatttaatactgttttttcccttttgtttctgaaaggagcagaggatagaaagacaattgttctagccctcaagtcccagtacactcattagttaagtgtgacggtggtcaagtgatgttgctttgtgtgtctgttttctcttaggtggttcaggtaccctgaaataaatcctaacttatatgtctgttgctcattcatctctgtgtgtggagaaagtgatttaaagtgtcctttctttaagaaggaaagagccagggcatagtggctcgtatctgtaatcctagcactttgggaggctgaggcaggaggattgcttcagtcaggaggttgagactggcctgggcaacatagtgaaaccatgtctctac

SEQ ID NO: 35134 - DNA, 266 bp, Homo sapiens
  misc_feature 4, 89: n = A,T,C or G
tccntttgtgccttttgtttttttttatggtgcttaaagtaaagagcccatccctttgcaagtcatcccattgttgttaccttaggccnttttatcttggctcaaattgttgaagaatggtggcttgtttcatggtttttgtatttgtgtctaatgcacgttttaacatgatagacgcaatgcattgtgtagctagttttctggaaaagtcaatcttttaggaattgttttttcagatcttcaataaattttttctttaaattcca

SEQ ID NO: 35135 - DNA, 422 bp, Homo sapiens
  misc_feature 5, 6, 24, 28, 404: n = A,T,C or G
gggcnnttccttgccaataccctnaacnagtgcctgaaaatcctgcagccatggtacctaaaggaagttaaagtttgaatgtaacccacctttattttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttatttgntgagcatgttggcattgt

SEQ ID NO: 35136 - DNA, 280 bp, Homo sapiens
ccacaaggcgcacctacaccccttatccccatactagttattatcgaaaccatcagcctactcattcaaccaatagccctggccgtacgcctaaccggtaagattactggcaggccgcctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctg

SEQ ID NO: 35137 - DNA, 493 bp, Homo sapiens
  misc_feature 2, 20, 29, 38, 49, 50, 51, 60, 62, 67, 76, 77, 93, 251: n = A,T,C or G
antgggcccgggagccaaanctgacttanaccgtaccnttaaaaaagannnctgtacccncnaatcnaagtggganntccctccctagggaantttcctttgtgccccttttcccccagttcctgtcccaaccattagtacctggaagtccttagcccagagccaattaagccaagacaaagccatcccagattggaaaggagagagtcaaattatcccctgtttgcaaaccagaatgaccgttttatttntattagaaaatccctaaagactcaactgaaaaactgttaagactaataagtgaaattaataaagttgcaggatagaaaatgtttgggtagtcagtaacatttctatatgctaatagtgaactaactgaaaaagaagtcaagaagacaatctcatttacaatagctactgaaaaaagatagctaggattaaatttaacaaaggagattaaaagatctctacactgataactataaaacattga

SEQ ID NO: 35138 - DNA, 468 bp, Homo sapiens
ggaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagtaagtagattcttctgttttactgcttttaaaaaaagtttaaagttttaaaatagtataaactttaattgggttctttaaattttgttgttgaataatgcaattattatgatattttgtgaatatttgtaaataatgggattctggaataaattaatccccgatgatagaaaagagttaatgaacactttctccatacataacactttagcattcaagaaacataggacttaaatacatatattaaaaatttaggccaggtgcagtggctcacgcctgtaatcccagcactttggga

SEQ ID NO: 35139 - DNA, 231 bp, Homo sapiens
tatggccggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 35140 - DNA, 433 bp, Homo sapiens
gaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttagcaggagtacttattctagtgtttgctggctta

SEQ ID NO: 35141 - DNA, 201 bp, Homo sapiens
  misc_feature 3, 16, 38, 66, 72: n = A,T,C or G
ccngggaattcggccnttatggcccgggcatttaaccnagccttctattatgccctttttctaacnacaganctttcttcactgtctttcatttaaaaagaaattaatgctcttaagatatattattttacgtagtgctgacaggacccactctttcattgaaaggtgatgaaaatcaaataaagaatctcttcacatgag

SEQ ID NO: 35142 - DNA, 396 bp, Homo sapiens
  misc_feature 16: n = A,T,C or G
gggagccgagcccggnctggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagactttt

SEQ ID NO: 35143 - DNA, 472 bp, Homo sapiens
  misc_feature 21: n = A,T,C or G
attgcatataaaaattaactnaaagttgacctaagatctaaatgtaagagctaatattataagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaagaccaataagcacatgaaaaggttctcaacatcactagccatcagggaaatgcaaatgagatctacaatgagatatc

SEQ ID NO: 35144 - DNA, 107 bp, Homo sapiens
cgggaggctgaggcaggagaatggtgtgaatccaggagggggagcttgcagtgagccgagatcacgccactgcactgcagcctgtgcaacagagcaagactgcatct

SEQ ID NO: 35145 - DNA, 365 bp, Homo sapiens
atagattaaaagtctctgtagacatctctgtgaagagcaagctatcattaaacatgtctgtttatcagcactgtctctttattcctttcccaacccattttaatagttctgacaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaag

SEQ ID NO: 35146 - DNA, 294 bp, Homo sapiens
actgtatctgttttccttcaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctatttttcagttgtgtgtaagc

SEQ ID NO: 35147 - DNA, 391 bp, Homo sapiens
gggtgtgatgacctgcgcctgtagtcacagctacttcagaggctgaggcaggagaatcacttgagcccaggagttagaggctacagtgagctgcggctgcgtaccactggtttcaggctgggtaacagagcaagatcccatctctaaaataaataaataatgaagaaagaaaaaagaaaacccatcgacagatgtattccactgaaataggctccaattaagtagtacacttaattgaaatagttgctgagaatactcccgaacaaagagaaactgttaatactgcctgattgttttatgttacaaagtaatttctaaaccattgggagttgtaaaaattcgagtcagttggttcttaaggaatgtgaaacataatgtacttcatatacac

SEQ ID NO: 35148 - DNA, 198 bp, Homo sapiens
atctgtgaagaggaaaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctc

SEQ ID NO: 35149 - DNA, 372 bp, Homo sapiens
  misc_feature 24, 30, 32, 45, 47, 239: n = A,T,C or G
gagtctgaagatggcggcctcagnagccgngnggtgctgcgccgntncgtagaagtatcaatcagccggttgcttttgtgagaagaattccttggactgcggcgtcgagtcagctgaagaacactttgcacagttcggccatgtcagaaggtgcattttaccttttgacaaggagactggctttcacagaggtttgggttgagttcaggttttcttcagaagaaggacttcggaatgcnctacaacaggaaatcatattatagatggagtaaaggtccaggttcacactagaagccaaaacttccgcaaacatctgatgatgaaaagaaagatttttgagactgcagcctattaataaagttaacataactg

SEQ ID NO: 35150 - DNA, 472 bp, Homo sapiens
atgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcgggaatatctctttgacaagcacaccctgggagacagtgataatgaaagctaagcctcgggctaatttccccatagccgtggggtgactttccctggtcaccaaggcagtgattgcattgttggggtttccttttaccttttctataagttgt

SEQ ID NO: 35151 - DNA, 160 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacacctgtctgagcgtcgcttgag

SEQ ID NO: 35152 - DNA, 471 bp, Homo sapiens
  misc_feature 19: n = A,T,C or G
ataattctgaaaactaatngcactttttaacaatgtttataatcctataagtctagatgtatccaaaggtgaagtatgcaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttgggaggttgcagtgagctaagactgcaccactgcactccagcctggtgacagaacgagactctgtctta

SEQ ID NO: 35153 - DNA, 398 bp, Homo sapiens
  misc_feature 391: n = A,T,C or G
gattattataaagctacaaataatgatgcatacaaaacatgtactgaatagccctttagacacattgatgttcatgtttttcccacagaagaaggcatttgttatctattttgaactctgcacaaagcatgatcttctgcacgttgttaagaatgtcaaatgacttaatgaatattaagttcctacttccctgccttgataagtcactacaaattaggtaatacttttgtatgtatggttttgaaatatttacacagtttggtgtttggatattcttgtctggtaaatcagaaaaaaaatctacttttaaaatcaggtgtatttcttgtaaggacaatgccaacgctattgcaattctttctaaaaataattgaagacttattaatacatnatatttg

SEQ ID NO: 35154 - DNA, 201 bp, Homo sapiens
  misc_feature 87, 155: n = A,T,C or G
aacagggaattaattaataatatatttatttatttggagacagggcgtctgtcacccaggttggagtgcaggtggtgccatcttggntcacttcagcctctacctctcaggctgaggcgggggagtcaccttgaacccaggaggcggaggttgcnggtgagacaagatcagcctgggtgacagagcaagactccatctcac

SEQ ID NO: 35155 - DNA, 232 bp, Homo sapiens
attggggaataagcataaccctgagattcttgctactgatgagaacattatctgcatatgcccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 35156 - DNA, 405 bp, Homo sapiens
gtacatgttggagtttgaagactgctctgtgtttgaatgggatgtcattctaatctccacgtttcttcataaatttttcactaattattgaagtatagcaaatgttcgttacagaaaataggggaattcagctgggtgtggtggttcacgcctgtaatcccagcactttgggaggctgaggtgggcagattgcttgagctcaggagttccagaccagcctggccaacatggcaaaaccccatctgtattaaaaatacaaaattagcctggtctgatgtctggcacctgtggtcccagctacttgggaggctgaggcaggaggatcacttgaacctgggaggcagaggtagcagtgagccaagattgcgccactgcactccagcctgggcaacagagggagaccct

SEQ ID NO: 35157 - DNA, 117 bp, Homo sapiens
atggtgggaattggttagctaaaatatcaattccctgggtaaaagaggaaaaccatgagaccctctaatcttaacttttctccttcaaaagagtggaaaaagattacatagttcctc

SEQ ID NO: 35158 - DNA, 245 bp, Homo sapiens
attccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaaccctt

SEQ ID NO: 35159 - DNA, 304 bp, Homo sapiens
gttattgtgtatgcttcatcacctatattaggcaattccattttttcccttgcgctaaggtaaagatttaattaaataattttggcctctcatagttttctctctctttaaagagaataaatagagggccaggtgtggtggcccacgcctgtgatcccagcactttgggaggccaagacgggcggatcatgaggtcaagagatcaagatcatcctggccaacatggtgaaaccctgtctctactaaaaatacaaaaatgagctgggcatggtgggggcgtgcctgtagtcccatgtacttggga

SEQ ID NO: 35160 - DNA, 127 bp, Homo sapiens
ggagcgcagagcggtttggtcgttcgttgggcggtgctggtttttcgctcgtcgactgcggctcttcctcgggcagcggaagcggcgcggcggtcggagaagtggcctaaaacttcggcgttgggtg

SEQ ID NO: 35161 - DNA, 157 bp, Homo sapiens
ctaggatactcctcaatagcctcgctgtagtatatccaaagacaaccatcattccccctaaataaattaaaaaaactattaaacccatataacctcccccaaaattcagaataataacacacccgaccacaccgctaacaatcaatactaaaccccc

SEQ ID NO: 35162 - DNA, 335 bp, Homo sapiens
  misc_feature 6, 7, 62: n = A,T,C or G
tcggcnnttatggcccgggactgagaccaaaccttagttttacagctgtcttgattaaagcnagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataac

SEQ ID NO: 35163 - DNA, 139 bp, Homo sapiens
  misc_feature 24, 135: n = A,T,C or G
agccgtggggtgacttccctggtnccaaggcagtgcatgcatgttggggtttcctttaccttttctataagttgtaccaaaacatccacttaagttctttgatttgtaccattccttcaaataaagaaatttggnaccc

SEQ ID NO: 35164 - DNA, 281 bp, Homo sapiens
  misc_feature 8, 9: n = A,T,C or G
cggggaanngctctctgtatactgctgaagattctatagtttctcctgaaatccatgagggagccccctgaaggattttggacaggaaagtgtcatgaatcaaatttctattttaagaatagtatcgaggcagcaatgtcaaagtttgtttagaaaataggatggttcctgtaatcccagaacttttggagaccaaggcgggaggattgcttgagtccaggaatttgagtccagcctgggcaacatagtgagacctcatctctacaaaaaaaaaaagtttt

SEQ ID NO: 35165 - DNA, 336 bp, Homo sapiens
  misc_feature 3, 13, 48, 54, 60, 61, 313: n = A,T,C or G
acntgtgtgggcnagttacctaagggggaaattcctgccctcctgacngttccnttttcnntttggtctttaaacacccctgtccgtgggatgtgcctcactgatttgtggctatgttgaaggtatcaccttgtcttgagggttttcaatatttcaggatcatgctggtggcaaaaggactccatgccctctgtggaatcatgtccacagggggaccctgcctcccgtgatgtcccacctttccttcaaggtctgtcatatgagtcctccccttttacaacacttatatgggtattttttcaaagttattctntttagattttgcagtacctactg

SEQ ID NO: 35166 - DNA, 470 bp, Homo sapiens
  misc_feature 4, 6: n = A,T,C or G
agantnaattttctttaagaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgtttctaagcacttcctgtattgcatatcaactcatttaatcctcacagcaatgtgagatacataccatcctccccattttataattgagggaactgaagcatagacaggttacatagctggtgactggcagatgaattgacttagccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagctttttgaatgacagac

SEQ ID NO: 35167 - DNA, 473 bp, Homo sapiens
ggccttacataatggtaaagggatcaattcaacaagaggagctaactatcctaaatatatatgcacccaatacaggagcacccagagtcataaagcaagtcctgagtgacctacaaagagacttagactcccacacattaataatgggagactttaacaccccactgtcaacattagacagatcaacgagacagaaagtcaacaaggatacccaggaattgaactcagcactgcaccaagcggacctaatagacatctacagaactctccacctcaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagagctcaggattaagaatctcactcaaagccgctcaactacatggaaactg

SEQ ID NO: 35168 - DNA, 338 bp, Homo sapiens
  misc_feature 6, 14, 95: n = A,T,C or G
cggganctcggccntttggccgggttctaaggttgatgaagcctgtagcctgtacctacaagcccccccaagctaaagaggctgcccagaaagcnagttaacagtgcccacccggtgttccaacctgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaac

SEQ ID NO: 35169 - DNA, 297 bp, Homo sapiens
ggcctggtcgatgcccatgccttttgaaaaagaatggatagaatgtgcacatggaatcggttatacctcgggcagagaaagagtgcaagatagaatatggatgatttcgtagaagtgtttgcttcggcagaaaacgatgagacgtgcaggtaccatcaggaagcagcgggataagctgataaaggaagggaaagtacacccctccacctcaccacattggcaagggggagcctcggccctgaacagagcagctgctgatgtctggaggctgattttcctgttctctgttctccactg

SEQ ID NO: 35170 - DNA, 428 bp, Homo sapiens
aattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaaggat

SEQ ID NO: 35171 - DNA, 261 bp, Homo sapiens
  misc_feature 4, 10, 22, 46, 62, 68, 75, 79, 88, 101, 107, 115, 154, 252: n = A,T,C or G
aacnagcccntttgggagggcnagggtgggatccgctttgaggtcnaggaagtttgataccnagcccntagcccnaacntagtgaaancccccattcctcntcctanaaaatacnaaaaaattacccctgggtgccagcctacctcagggaggnctaaaggcattgaagaaattgctttagccccgggaggaggaggttgcagtgagctgagattgcaccattgccctccagcctggatgacagagcgaganctccatcgc

SEQ ID NO: 35172 - DNA, 429 bp, Homo sapiens
  misc_feature 33: n = A,T,C or G
actccaaaataggcaataattgtttatcttttnacaaatactttgagtacctcctactgtgcccaactctgatctaagcacaagagagacatcagtgaatgccatcatcaaaaagtctccctgtcctcatcttattaggtaaaaccatatgaaattgctgtttttctagttaaaccaattgagtataaataacacctactatctgatccagccattccactctcaggtatttaactaaaagaaataaaagcatacaccctcggatttgtacaccaatgtttgcagcacctgtatctgtaatagcccaaactagaaacagtccaaatgcaaaaacagtgatatgtccatagaatggaatactacacaacaataaaaaggagtgagatactggatatggtactacaacatggggtggacttcagaaacact

SEQ ID NO: 35173 - DNA, 409 bp, Homo sapiens
  misc_feature 2, 15, 388: n = A,T,C or G
anttttgaaaattcnaaaagcctttggttttaaacctcttttaagaaatattagtacctcggtcaggtattgaccggctcaccgccctgtaatccccagcacctttgggaggccgaaaccaggcgaatcaccttgagccccaggagttcaagacccaacatgggcaatgtggcgaaactccatctctacaaaaaatgcaaaaataaaaaatatagtacctcaagtattcttgatcctgtgtttcaaaactagaatttgtaatgcaaatggagctcagtctaataaaaaagaggtttttggtatttaaaaagttcatacattagacagtatcagccaaaatttgagttagcaacactgttttctttacgagagggtctcacccaaattntgggggagaaatctatttcgc

SEQ ID NO: 35174 - DNA, 372 bp, Homo sapiens
  misc_feature 16: n = A,T,C or G
gcggtcaaggcagccntctcgccgtgagacagcaagtgtcggatccgcaggcgcagccgtgcgatgttgtcctctacagccatgtattcggctgctggcagagacttggggatggaaccgcacagagccgcgggccctttgcaactgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtat

SEQ ID NO: 35175 - DNA, 496 bp, Homo sapiens
  misc_feature 2, 7, 27, 31, 43, 45, 47, 77, 90, 100, 137, 145, 418: n = A,T,C or G
cnatctntgggcccggggggccgagcntccngcccgaaggagnangngggggtaaagtaaggaggtctcttgtaccnatggcttcgtacnaaagccaganctgccccgcaaatccgaccggtgggtaaaagcacccnaggaagcnaactggctaccaaaaagcccgctccgcaagagtgcgcccctctacctggaggggtgaagaaacctcatcgttacaggcctggtactgtggcgctccgtgaaattagacgttatcagaagtccactgaacttctgattcgcaaacttcccttccagcgtctggtgcgaagaaattgctcaggactttaaaacagatctgcgcttccagaagcgcagctatcggtgctttgcaggaggcaagtgaggcctatcttggttggccttttttgaaganacccaaccctgtgtgctatccatgccaaaacgtgtaacaattatgccaaaagacatccagctagcacgccgcatacgt

SEQ ID NO: 35176 - DNA, 100 bp, Homo sapiens
  misc_feature 2, 5, 10, 14, 23, 26, 28, 49, 56, 70, 83, 90, 92: n = A,T,C or G
cngcnagtcnttcnttcccaatngcnangtttccaccttcttctttccnccacttngcccccacgaagcnagcaaacctcccngttttcntnggtttttt

SEQ ID NO: 35177 - DNA, 417 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcttggaggttttgaagatg

SEQ ID NO: 35178 - DNA, 125 bp, Homo sapiens
ggtggcacatgcctgtagtcccagctacttgggaggctgaggcaggagaatcgcttgaacctgggaggtggaggttgcgatgagccgagatcgtgtcatggcactccagcctgggcaacaagagc

SEQ ID NO: 35179 - DNA, 395 bp, Homo sapiens
  misc_feature 3, 16, 65: n = A,T,C or G
gcntcccgggttgacnaaactgggtggggtaaccagaaaaggaacctggcctacccgttccgganctattttgtagtcatgtacagaaacatgatcaagggtgttacacctgggcttcccgttacaagaatgaggtctgtgtatgcctcaccttccccatcaacgttgttatcccaggagaatgggtctctttgttgaaatccgaaatttcttgggtgaaaaatacatccgcagggttcggatgagacccaggtgttgcttgttcagtatctcaagcccagaaagatgaattaatccttgaagggaaatgacattgagccttgtttcaaattcagcggctttgattcagcaagccacaacagttaaaaacaaggatatcaggaaatttttgggat

SEQ ID NO: 35180 - DNA, 409 bp, Homo sapiens
  misc_feature 8, 17, 44, 48, 59, 88: n = A,T,C or G
ccgggaanttccggccntttatgggcccggggggaaaaagtaancccntaaaagttacnttgccaaaggtaaagccctctttaaaganctacaagtgtcagcctgaatgaaaaaaggtagggtgggcccaggcaccagcggctcatgcctttaatcccagcactttgggaggctgaggtgggtgaatcacttgaggtcaggagtttgagaccagccctggccaacatgatgaaatcctgtctctactaaaaatataaaaattagccaggcattgtggcaggttcctgtaatcccagctactcgggacactgaggcaggagaatcgcttgaatcctggaggcagaggttgcagtgagcccaggtctcgccactgcactccagcctgggcgacagagtgagactccatcac

SEQ ID NO: 35181 - DNA, 154 bp, Homo sapiens
  misc_feature 15, 19, 35, 40: n = A,T,C or G
taatgggccgggagngganggagcctttaaagtangcccnaagccctgagttcacctcccatgttcctctagaatggtcttggataagtccctgtcctccaccttaagtttggattttgtccccaagaaagatttgattcttatttcctttacc

SEQ ID NO: 35182 - DNA, 357 bp, Homo sapiens
aggatagggtctatgtcttgagtctttaaatatgtgactctcaatataatacctggcatatgataataagtcatagacttaaaatgttgactaaaggacagaacacttgaatatagaatctgtgaatacttgtgcagaactcaatactttatttgatattgctgttcataaaaagattcattcttcaattaaaacatgctattttacttacctgtcagatggataagatcaaaccgtatggtagcacaatgagctacctagtatgtgggcatggggcactctcatacattgttgtgtggagtatgaattgattcatttaatatttgcagggcaatgtggtaataactattaaaactt

SEQ ID NO: 35183 - DNA, 434 bp, Homo sapiens
  misc_feature 9, 11: n = A,T,C or G
tccggcccntntggcccggggtgatgagatgaaatgatgagatgaaatgatgagatgagatgacctgaaataaatgaaataatgaaatcgaaatgagatgagaagatacgagatgagatgaaatgatgagatgaaatgatgaaatgagataagatgaaaagagttgatgagatgatgagatgaaatgagatgaaaagagatgaaatgagatgaaatgaaatgatgagatgaaatgaggtgaaatgaaattagatgaaacgtaatgagatgaaatgacctaatgaaatgaaaaaatgaaatgaaataatgaaatgaggtgaaattaaatgagatgatgaaattaaatgatgaaatgaaataatgaaatggaaatgaaatggaaatgatgagatgaatgatgagatgaaatgatgagatgagatgtaatgatgaga

SEQ ID NO: 35184 - DNA, 168 bp, Homo sapiens
  misc_feature 5, 24, 29, 30: n = A,T,C or G
tattngccggggggtctatgaaanaaganntggacccaacagcagtcctcccttcagcacggcgtggtgtgtccctggacaccagctcttcattccattgacttagaggcaacaggattgatcattcttttatagagcatatttgccaataaagcttttggaagccgg

SEQ ID NO: 35185 - DNA, 271 bp, Homo sapiens
  misc_feature 1, 14, 25, 36, 62, 137: n = A,T,C or G
nggcccaagttatnaatttgcctancatttgataangtattcagcctgaggcctgaaaaccncccaattttaacaaaaatcagcatatttcttcagtattgtgtggtgcttatctccttgggagcagaaagcagagnctggattaatccaaaatcagggataaactgaccaggaggagcagaggaataatgggcccaagagtactgaggatgcaagtaaaagtgctcaaattactgtattgaccttgtaatcccaagctgatcggggaagc

SEQ ID NO: 35186 - DNA, 417 bp, Homo sapiens
  misc_feature 1, 9, 45, 67, 92, 106: n = A,T,C or G
ngtgtttcnctgtcctcatgtacctagtgaaagtagatgtgtgcntttgtgcccatatccctatgtntcccctatcagggctgtgtgtattngaaagtgtgtgtgnccgcatgatcatatctgtatagaagagagtgtgattatatttcttgaagaatacatccatttgaaatggatgtctatggctgtttgagatgagttctctactcttgtgcttgtacagtagtctccccctttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaacaataactaacaataaaattgaatagttat

SEQ ID NO: 35187 - DNA, 499 bp, Homo sapiens
  misc_feature 10, 29: n = A,T,C or G
tccggccctntatggcccgggggaagaanagatgagtaccaaaaagaggaagagtatggagaattttactaacaaattgaaatgtataaatggcaaatttatacatttagagcaaatttatattttagagcagagaactcagtgtgcaaattacatagtaggtatgacaaagcaaaagacagaatgaatgaaaaggaaaagaagtcagtagaaaatattgaaaatgaattacagagattaaactgatatgtgagacagtgaaaatatctaatacatctgtaatgttaggaccttttagcttagcaggagaggatgtagaaaatgggacagaagcagttttgatgaggtaatggctaagaattttccaggactttttaaaaacattatctgatgaattgagggaagctgtatgagcctgaaacagtgtcagtagaaagacggttacacctacagatatcttagtaaaactacttaaaccaagacaatcctaaaagcagct

SEQ ID NO: 35188 - DNA, 465 bp, Homo sapiens
ggaaaactgaacacactgttgcagagtagccccccagtgccttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggcatggaattttaattctgttactgtgtgaaatcttctttttaaaagaatgtttttcctacatattctgcttgtgtaactatgttaaatctattaggacttaggcctcctgaaagttaacattttttccagcaatactgcttcaggaattaaaattgccagttgttacatatgcatataccgtttggtctgtttttatt

SEQ ID NO: 35189 - DNA, 412 bp, Homo sapiens
  misc_feature 2, 11, 182, 309: n = A,T,C or G
tnggccggganggcctgtatttttgtacatgatccccgtgtttaataagatggatgattcagtttcttctgtgaattcaggttgtgatatttgcatctttggaaatgctatttaggaaataaataccagcatggaaattcatagtttgttaattttcttgaagctacaaggcctggtgcggnggctcatgcctgtaatcccagcactctgggaggccgagatgggtgaatcacctgaggtcaggagtttgagaccagccaggccaactaggcgaaactctgtctctactaaaagtacaaaaagtagctnggcgtgggtggtgcgcatctgtagtcccagctactcaagaggctgaggcaggagaatcacttgcatctgggaagcgggaggttgcagtaagctgagatcatgc

SEQ ID NO: 35190 - DNA, 166 bp, Homo sapiens
  misc_feature 6, 52, 76: n = A,T,C or G
tggtantttttaccctttgccagtgaaattgcattgtgcctaattgtaaccncagcctattttttatgttgaccantaacctcccaaatgttatattaaatgttctattatatattagctctaatccccttaagtaaattttaagaaataaatacttgttcaaatt

SEQ ID NO: 35191 - DNA, 227 bp, Homo sapiens
  misc_feature 8, 9, 25, 113: n = A,T,C or G
cgggggannttggggagtctgcgcntaggccccgcttggagttcctgagcccgatggaagagttcacctcatgtttgcacccccgcggtgatgccgtgcttttcgcaagaaanagactctcggctatggagtccccatgttgttgctgattgttaggaggttcttttggtcttcgtgagttttctcaaatccgatatgatgcttgtgaagaagtaaaatggatcctg

SEQ ID NO: 35192 - DNA, 393 bp, Homo sapiens
  misc_feature 12, 14, 39: n = A,T,C or G
atgggccggggnanctggccctgttgttaccttcagaanagggcaaaggcatttattgaaaaaacaataggcaaaagggaaaaggaacagacaacttgatataactatcttatacacattaagaacaaagaaagatcatatgaaccctaaatgacacctcaacaaggatattaacataaaggactttttcactgcaggtctaattaactattaacctttacaaaatcagtgtccttgggaaaactgaaatataagacagatacttatctctgagattgctgcagtgtctgctgatagaggaaattcgtaagaagcagaaactattatgtaaatctcagtaaaacacttatttataatggtcaaaaatggaatattgggtaaattgaacatttg

SEQ ID NO: 35193 - DNA, 417 bp, Homo sapiens
  misc_feature 3, 4, 27, 28, 34, 38, 44, 122, 391: n = A,T,C or G
ctnngggcccggggagtttggacattnnctttancacnttttanttttgtttaatgtctggtgcctttcctatcaccctcttctaatcttttaatgtattttgtttgcaattggggtaagancttttttatgagtacctttttctttgaagttttagccggtcaatttgccctttttaatgaacatgtgaagttatacctgtggctatgcaacagctctcacctaccgccgagtcttactttgagttagtgccataacagacccactgtatgtttacttctcaccatttgagttgcccatcttgtttcacactagtcacattcttgtttttaagtgcctttagttttaacagttcactttttacagtgctattacctgaagttatttattnaaaaaatgccctaaaataccttaaat

SEQ ID NO: 35194 - DNA, 381 bp, Homo sapiens
cagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaaggtgtagcccatgaggtggcaagaaatgggctacattttctaccccaga

SEQ ID NO: 35195 - DNA, 357 bp, Homo sapiens
  misc_feature 7, 46, 58: n = A,T,C or G
tcggccntttattgggcccggggtcccgcagcagcaccctagcacnggctgactaganagatcagtgtccaggagtaatggcagtcagatagtggacccccctacatacatgggacacaagctgctgcctttatcatgggtctcttttttttgttgttgttgttgttttgttttttgtttttttggtcgggagcgaggatggagtctcactctgtcgccaggctagagtgcagtggcacgatctcagttcactgcaacctctgcctctcaggttcaagcgattctcccatctcagcctcccaagtagctgggaatacaggcgcccgtcaccacgcccagctaatttttgattttagt

SEQ ID NO: 35196 - DNA, 199 bp, Homo sapiens
  misc_feature 5, 19, 28, 32, 64, 72, 87, 92, 95, 150: n = A,T,C or G
taatnggccggggaactcnttaatcggnggancaacttacggcttcgtggccgtccgaatgaangaaacgcnagctagcctgcgaanaaatnaanggtgaaattggcaggacacattgatcactccgacactttcgaaaccgcacttgcngccccgggttcctcccggggctaccgcctgtctgagccgtcgcttgcta

SEQ ID NO: 35197 - DNA, 363 bp, Homo sapiens
  misc_feature 9, 18: n = A,T,C or G
gtgaatacncctgaggcnaaaaaattaaagctctccaactgtggggtattcattctgttcactgtggccagtgtggtgatcagtactggccacaccagtggccaaagagaactgcattcatcatgtggctgttctatagctgtgagctatggtgactgttatttttcctagtgatagttttcagtgacagcatagattctggtatcatatccaaggaataaacaaacactgtttttggctttttgttttttttggtttttgacataaaaataataagctatttttggcatatgcagacttttcacaaagtgattgttttcttgagctctggactacttggtaacattcataagttccttcact

SEQ ID NO: 35198 - DNA, 281 bp, Homo sapiens
atttacattcccccgtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatat

SEQ ID NO: 35199 - DNA, 187 bp, Homo sapiens
  misc_feature 1, 12, 15, 20, 24, 28, 106: n = A,T,C or G
nagttaatcccntcntttcnttancgantgttgaaagaagtgatcattgggctattttttccaaagagagtatcttgtacatttcaatttgccctgatggaaaganctatctcaaagtggaaaatagtacccatcgagcctggatgtgtttaggatctaaggtttacaaatgtattaatttcctctc

SEQ ID NO: 35200 - DNA, 138 bp, Homo sapiens
  misc_feature 2, 30: n = A,T,C or G
tnggcccgggtggtaccaaaaaccttcatnttaaaagtgtttttctacctgaatcccgggtatttcctgaaagatcgaagccctgtgtaaaatgcctacccaaatggcaaaaagcaaccaataaacagtttgattttt

SEQ ID NO: 35201 - DNA, 175 bp, Homo sapiens
  misc_feature 2, 7, 26, 34, 49: n = A,T,C or G
anctaanagcagaatctaccctcccnaactgccntgtgaattaaagaanatgggtccttgagtccctgtgcctgttggcaaagtgccaggccaccagttggggaggggggggtccttaacaagcgtgactttgctcattctgtcatcactaaggcaataaaccctttgccaggtt

SEQ ID NO: 35202 - DNA, 384 bp, Homo sapiens
  misc_feature 7, 21, 30: n = A,T,C or G
tcggcanttttggccgggganctgggaganagtccacttaaatgcagctccagggttgcgaggcacccaccagcatcattccccatgccgaggtggcaaatgcaccatgctctccagtttggggtgtctacttctctgtggaagtattacactagcccctgggaaatgcacagaaattgccaaaaggtaaaaggccaaacctcaaagtccacatcaatacccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctttagttgaatgcagagccgaaata

SEQ ID NO: 35203 - DNA, 497 bp, Homo sapiens
  misc_feature 3, 10, 24, 37, 61, 438: n = A,T,C or G
aantcggccnttatggcccgggcnagtaaagcagatnttgcaccagatggtcagaaaagcncccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtatttaatacaaggctgtttaaggtcaaagaaagacacttgtttcttacctatttanggaagagcacagtatgatccagcaaaacctaactacatctctttggacaaactagtatc

SEQ ID NO: 35204 - DNA, 395 bp, Homo sapiens
  misc_feature 8, 9, 45, 393: n = A,T,C or G
tgaaaaannaagtagtcctggggtttaattctattggcaagagancagcctttccttaattttagccctagtgaattgttatgggcctataattcaaatgtaatgatctgactcattgaaatgataagattcccagctttaggcaggcatattgttcctcctcataagaaagtcaattattttagacatcaggtaccccctcaacttttctttaaatagaagacagacacctgttaactgtcctaactagggcaaatgtttgagtcaccagagcttatgcgaacatgtgtagttccgtatttgaatctagtgagcccattgctaatgatggcatacagttcaagaagatttcactgttgacaaagactatatgttcccctagtagttttctgnat

SEQ ID NO: 35205 - DNA, 211 bp, Homo sapiens
  misc_feature 12, 16, 28: n = A,T,C or G
cgggggggtatnagantgttgcctaacnagccaaccaccaaagcttttgcatattgcatacctattaaacattgcctgtacattacctttttgggtttattttggaaaggaatgcaaagatgaaggtctgttttgtgtacttttaagactttggttattttactttttggaaaagaataaaccaagaattgattgggcacatcatttcaag

SEQ ID NO: 35206 - DNA, 483 bp, Homo sapiens
  misc_feature 2, 10, 38, 57, 74, 86, 107: n = A,T,C or G
cnagtaatcncctggtgtccgatatttgtcctgaaccnttcaccctgccaggaaaanaagtttcaccaaaagangcctaccaagangtaccattcaaagattaccantgaaatcaatcaaagggaaaccttgaagaacagagacccagaaagagtaaaaccttttatgacaggggcctgcagaacaaatcaagcacatccttgctaatttcaaaaactacccagttctttatttgggtgaaaacatgaatccagatggcattggttgctctattggactaccgtgagggatgggtgtgaccccatatatgattttctttaagggatgggttagaaatgggaaaatgttgacaaatgtggcaattatttttgggatctatcacctgtcatcataactggcttctgcttgtcatccacacaacaccaggacttaagacaaatgggacctgatgtcatcttgagctcttcatttattttgctgtga

SEQ ID NO: 35207 - DNA, 463 bp, Homo sapiens
ggtgaaaagacaagtttttctcccttttggaaagctattttgcttaagctcctatgaatacatcaattatattagccctgagagtgtctgtcagtgcaatgttaaaaggtccactatttttcagactgcccacatcagaaacaaaatacccttcaaactctctgccctgaattgcttgggccaaagagagcttgagagaaaaaggcataaactccacaacattgacagtgagaagagccactggttttaagtaaattgtagtcatatttatcagcttaataaaatccccccagcactcgtgtgccatcaaattcttcaatttcaaattcaggaaaaatggctcttttgtgacagaaggtataaggccaaagggcaggttgtcagcgagaccgcctcccctgcaggccagttgggcttggagctttgggaaggcaagtttgcaagagcccaggcctgttgcaga

SEQ ID NO: 35208 - DNA, 400 bp, Homo sapiens
  misc_feature 2, 20, 35, 36: n = A,T,C or G
tncccccgggaattcggccnttatggcccgggaannccagatttaagcaccctatcagttacaggatataaattctccaaacaaggaaaaggttgctccccctgaagaagctcaccgtccaggaccccctgaagaagctcaccgtctaggaggggatgtggagaagtaaacacattatcataattaccgtggaaggggctgtggttgaagtaaactcttggcactattagggaagctcccctgaggaaagtctgagagtgtgagtggcaattaaatgatggtaggggagggcagtctggcaaaggatcttctcgttagaataaacaacatgcccaggtcctttaaaaagagggggagatgagacaggcccagagtcgtggggaggtaaggtgggccggac

SEQ ID NO: 35209 - DNA, 294 bp, Homo sapiens
gggtgcggaggtcagggacaagatggtgccccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgat

SEQ ID NO: 35210 - DNA, 424 bp, Homo sapiens
  misc_feature 3, 15, 30, 36, 337, 392: n = A,T,C or G
tantgggcccgggcnaaagttcctgaaaantattcntctgtagtttcttttggaagtctcattgttttatttttcacatttagatctattcatatacatataattaattttgtgtattatatgagggtatcttcttttacattatttctatctagatgacccatctagattggttattgggaatgaccatcccttctccactgctttgcagtgatagctttctcatgaatcaaatatttgtacatgcaaagacgttactggattgcctcctaggtcctatttgtctaggcatatattctgttggcaatagcacgctttgttaatactaagagtggtnaaaaaactcttgacatctctgaagtcttttaattcctggtttttcttcaggggtnggcttggcaaaatttttgcccatttaatttta

SEQ ID NO: 35211 - DNA, 321 bp, Homo sapiens
  misc_feature 5, 9, 29, 39: n = A,T,C or G
ctggnaaangaagcagagtataccgcaanattcttgtcnaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaacttgc

SEQ ID NO: 35212 - DNA, 184 bp, Homo sapiens
  misc_feature 5, 16, 70, 148: n = A,T,C or G
atccntttgggcaganataattgggtattgggtttccattttttatgcttaaggttatcatggccaggcntgggggcttttgcccataattccagccagattgggaggctgaggtgacaagatcaccttgagcccaggagtttgaganccagccctaagcaatgtggcaagaccctccctctac

SEQ ID NO: 35213 - DNA, 235 bp, Homo sapiens
  misc_feature 14, 29, 48: n = A,T,C or G
attggccgggtacnaagctgattgagagncttatttaaaacgtaaacnctacaagatgtcattgcttccttgtagtgaagtgaaaaggaggtattggattaagcatttaaagttaattaaagtagtggctcgtgcctgtaatcactggctacttcagaagtcttgaggtatgaggatcatttcatgccaggatttctagaccagctaggcaacataatatgacccctgtttcttc

SEQ ID NO: 35214 - DNA, 473 bp, Homo sapiens
  misc_feature 16, 446: n = A,T,C or G
gacaccttagccaacntttacccaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagtaaaaaanttaacacccatagtaggcctaaaagca

SEQ ID NO: 35215 - DNA, 151 bp, Homo sapiens
tatggccgggataatagggctagttttggttgaaaacttgcccttaacatcattcaccttatgctgtccaaggtttttatgaccctttaaaaaaaagatatagccttgcactgcactccagcctgggcaacagagcgagactccatctcat

SEQ ID NO: 35216 - DNA, 161 bp, Homo sapiens
acaagaaaaattagccgggcatggtggcacatgccctgtaatcccagctactcgggagtctgaggcaggagaatcacttgaacctgggaggcagaggttgcagtggaccaagatcacaccattgcactccagcttgggcaacgagagcaaaactccgtctc

SEQ ID NO: 35217 - DNA, 463 bp, Homo sapiens
gagtctccaggactccggaaacctaaaagtataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaaacccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctg

SEQ ID NO: 35218 - DNA, 249 bp, Homo sapiens
ggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaaga

SEQ ID NO: 35219 - DNA, 428 bp, Homo sapiens
  misc_feature 9, 13, 31: n = A,T,C or G
ggaagaagnaagntctgtgctcaataatctnttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcgggtaatacagacactcaggcagacgaggatgaaagagcccaggagagtcagattgatttcctaaattcagtaatagtggaccttcaaaggaagaatcaagacctcaaga

SEQ ID NO: 35220 - DNA, 334 bp, Homo sapiens
gttttggtaaaggagtctatggagtattaggctattaatgtgaacgatgatacatacacctcttgtttgtcaacattagaatttgacatggttactttagtagctcacatttttataagatataggcaaattattattcatttttgtactatatcatggccatcttaagtatataatgtattaaaattatttaagttaagtacattaagatagctgagcaggcagtattattagaactcaggtgatactttgctctatcaatttaaatttttaaatatgatactcttactttactcagttacagaagttctatcatttctatatcattgtggta

SEQ ID NO: 35221 - DNA, 379 bp, Homo sapiens
aatggaacactaggcatacatgggttaataaaaaattgttcttaatcacgataggcaccaaaatctgctggggagcgttctcacaatatgtgtattcaggtcccactgcaaaatacagagctaaacttgtaaaggcagagccaaagttatttgtattttgcaggggaaaaactcccgaagaggtcctcacgcacagccctagcaaggaatgatttcacaaaagcctctgattattagaaagttttccttttattgaagtgaatcctttactacgctaggaaaatcccgctgtcacctgagactctctcaaacccctgaagactccatgcgtccctgaagatttatgaagtgttgtctcctcatgagcctctctctttat

SEQ ID NO: 35222 - DNA, 462 bp, Homo sapiens
  misc_feature 6, 33: n = A,T,C or G
caaatntcagaacagtctaatcaatgccaagtncccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaaga

SEQ ID NO: 35223 - DNA, 262 bp, Homo sapiens
caatgggtaatgagtacaaaagaaagaaaatagtatgattaagatctagtatttgattgcataatcgggcgactgtagtaaataataattgaccatttaaaaataactaaaagggtataattggattctttgcaacacaaaggataaatgcttgagaggatgtatacatccatttttatgatttgctcattacacattgcatgcttgtatcaaaagttttcatgtaccccataaatacatacacctactatgtactactcac

SEQ ID NO: 35224 - DNA, 186 bp, Homo sapiens
gggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagc

SEQ ID NO: 35225 - DNA, 159 bp, Homo sapiens
gcgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttg

SEQ ID NO: 35226 - DNA, 401 bp, Homo sapiens
atgactgaacatttttatttcccattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcgggaggatgacttgagcccaggaattccaggctgcagtgagctgtgatagtgccactgtactccagcctgggtgacagagtgagaccctgtac

SEQ ID NO: 35227 - DNA, 350 bp, Homo sapiens
  misc_feature 90: n = A,T,C or G
caagcccagccttacatactgtgtttctctctctgtctgcatgcatattaaagtggaaaaattgtatttatatcttagttattaccatangtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgaga

SEQ ID NO: 35228 - DNA, 140 bp, Homo sapiens
  misc_feature 45, 56, 59, 60, 79, 116: n = A,T,C or G
aatattgcttgagatttataatacccttagaattaaattcctgtnatttgcccagnttnnaattacactgaggtgattntgaaaagaaatagaaattaagctgctatataaaacanttgtttacgtgtacttttaacttt

SEQ ID NO: 35229 - DNA, 373 bp, Homo sapiens
aatctcagtcctctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 35230 - DNA, 371 bp, Homo sapiens
gttaaaaaacatgtttcttacgtgtgtgtgtatatatttataactgacacatgtgattctttgtacagtatttagaatccttcccttcagatagcagtcctcttgtattcagtcttgtggctaaaatagatcaaaaacatattttaaaactgttaaagtaactgtatgactcatgcttgaagttctgaaatttgggagcgttatgaggtttccatgccattaaccgctagatcatttgcattctctcacagagtaaacggaaaaaaatttagaaaacttgtaataatcctgacttctttaataaaatgtgtcctgtgtattgcttaaatccatagtccagccttttctgagttcttgagccatgagatgga

SEQ ID NO: 35231 - DNA, 222 bp, Homo sapiens
gggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaagc

SEQ ID NO: 35232 - DNA, 226 bp, Homo sapiens
  misc_feature 31: n = A,T,C or G
aatgtcaggctttcctcggaaacgggtggcntggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgtcc

SEQ ID NO: 35233 - DNA, 125 bp, Homo sapiens
gacttagggcaatttgattctgcacttggggtctgtctgtacagttactcatgtcattgtaatgatttcactcctaactgtgacatttttatcaaatgtgtgaataaatacataaagattggtac

SEQ ID NO: 35234 - DNA, 289 bp, Homo sapiens
  misc_feature 6, 31: n = A,T,C or G
gaggcnttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagga

SEQ ID NO: 35235 - DNA, 210 bp, Homo sapiens
  misc_feature 12, 48: n = A,T,C or G
ggttgtccaagnatagaatcttagttcaactttaaatttgcccacagnaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacc

SEQ ID NO: 35236 - DNA, 422 bp, Homo sapiens
  misc_feature 32: n = A,T,C or G
agttgaaggagttgcatttatctttctggctnctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcgaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgttt

SEQ ID NO: 35237 - DNA, 330 bp, Homo sapiens
  misc_feature 6, 43: n = A,T,C or G
gattgngtctggcagtgctattatgaggagtgaagaccccagnatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaaga

SEQ ID NO: 35238 - DNA, 101 bp, Homo sapiens
  misc_feature 32: n = A,T,C or G
aaagaaaatgaagtacagagtctgcatagtangcttacagataccttggtatcaaaacaacagttggagcaaagactaatgcagttaatggaatcagagta

SEQ ID NO: 35239 - DNA, 331 bp, Homo sapiens
aagttaaaatatctgttatcctgccgaccttttctagccccatagtgggccattagagatgagcagaaagaatgcctgttaatgaactgccagcccactgcccagcagtgatttggtgcacataataataaattataagaaaaactactgattagacttgagtaagttagatgcaattcaagcttatgttggtggtggtggagaactgatcacacttttcataattttttaaaagtgttttattgagccacactttaggggaagttcatgattgaatggatctagtcattcagggaaatcctctctgtgtgaattaatacttcctttgtca

SEQ ID NO: 35240 - DNA, 464 bp, Homo sapiens
atttttagaggattgatctctggcacaacctgcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtcccgttctttagaaaaatgtaga

SEQ ID NO: 35241 - DNA, 370 bp, Homo sapiens
  misc_feature 30: n = A,T,C or G
agcctaaaaagaacaagatcatgttctttncggggacatggatggagttggaagccgttatcctcagcaaactaacacaggaacagaaaaccaaacaccacatgttctcacttacaagtgggcactgaatgatgagaacacatggacacatggtggggagcaacacacactggggcctatccgagggggtgaggttgggggaaggagagcatcaggaagaacagctaatgaatgctgggcttaattcctgggtgatgggatgatctgtgcagcaaaccaccatggcacacgtttacctatgtaacaaacctgcacatcctgcacacatacccctgaacttaaaataaaagattaagaaaaaaaaaagact

SEQ ID NO: 35242 - DNA, 379 bp, Homo sapiens
  misc_feature 4, 13, 17, 28: n = A,T,C or G
gggnggcctcagnaatntggtgggaggnttaaggcacttcttacatggtggcagcaagagaaaatgaggaagaagcaaaagtggaaacccctgataaactcatcagatcttgtgagacttattatctgtcagaagaatagcacaggaaagaccagccgccatgactcaaataccacctcctgggtccatcctgtgacacatggaattctgggagataaaattcaagttgagatttgggtggggatacatagctaaaccatatcagaacctttgtatataaaaggaacattgatagaggatgatgaaatcataggaaagaccgacagtttctgaaggactaattctataaagtctgctgtttaagagttcttaatagtat

SEQ ID NO: 35243 - DNA, 246 bp, Homo sapiens
ccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatga

SEQ ID NO: 35244 - DNA, 373 bp, Homo sapiens
agctatggaactctggtattgctttctaaattccctgttcagctggccaggcggtgggttctctctagctttagttctactgcaacgttcagagcaggcccatagtcttacaggccagagctcctctgttgtagccactcagctctgacatggttgtgtggaagccactgtggatgacacacaaagtgtgcactgttgtgttccaataaaactttatttatggatcttgaaatttgaatttatactgtacagttttcatgtgtcacaaagtattttcttttgatttaaaaaaatcatttaaaaatgtaaaacccactgttagtttggaggccatccaaaaacaggtggtgggctagatttggcccatggctta

SEQ ID NO: 35245 - DNA, 307 bp, Homo sapiens
  misc_feature 31: n = A,T,C or G
agaaactagtataaaattatataagatgggntaaaagaaaaaaatcataatcatttactgggtgcttattgtatgccagacactgtagtaaggaatttatccatattcatctaatctttataaacccacccccactccaccccagtaaaatttatattagtatccctcttttgctagtgacagagtaagctgagagaggatatgtaacttacttaggtcacacagacagtgaatggtagaaccagaaataaaactcaaatctggctgatctcaaagtcatgctttcaacaatgctatatatcatcca

SEQ ID NO: 35246 - DNA, 341 bp, Homo sapiens
ggagcagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatat

SEQ ID NO: 35247 - DNA, 450 bp, Homo sapiens
  misc_feature 32: n = A,T,C or G
aaggcatgtgtatgataatcccaagggtaacntcaagtaaaaattatagaaaaagataaagcgaacaacactataggtaaatcaaaataaagtagtacaaaatgttcaaatagcccacaggaaggcaggaaatggaaaacgggaataaaaaacaggggaagaataaaaataaaataataaaacggcagacctaaatcttgacatctgtaattacattacatgtaagtggtctaaacagacaaagattatcaaaatagattttttaaatgacccaattataatgcagtgtacaagaaaatcactttgaatatagtgctacaggcaggttaaaagtaaaaatatgaaaaaagatataccactttgacatgggtttttaaaaatcttgagtgcctatataaatatcagacaaagtaggcttcagagggctgggtgtgggtggctcatacctat

SEQ ID NO: 35248 - DNA, 140 bp, Homo sapiens
  misc_feature 8: n = A,T,C or G
gtcgcagnaggagtacaccgccgcagttgccggtacatcggggatttctggctctttcctcttcgccttaaattcgggtgtcttttatgaataatcaaaagcagcaaaagccaacgctatcaggccagcgttttaaaact

SEQ ID NO: 35249 - DNA, 149 bp, Homo sapiens
  misc_feature 31: n = A,T,C or G
aaacactgaactgacaattaacagcccaatntctacaatcaaccaacaagtcattattaccctcactgtcaacccaacacaggcatgctcataaggaaaggttaaaaaaagtaaaaggaactcggcaaatcttaccccgcctgtttacc

SEQ ID NO: 35250 - DNA, 441 bp, Homo sapiens
cattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatg

SEQ ID NO: 35251 - DNA, 144 bp, Homo sapiens
catttaaattaattatttacattgatgaaatagcaaaatgttaatgactaaatactgtcttggttttttcgttccaggtcagtcaatattaacttcttataattttcttttttttctttatgtgtgtgtgtgtgtgtatttttt

SEQ ID NO: 35252 - DNA, 462 bp, Homo sapiens
  misc_feature 30: n = A,T,C or G
ggaagtgcccctgaccgtcgacagcaaccncatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttataatgaagttcctagatgatttaaagctgtaagaagaagaataatgaatcataagaaaacttgctgctacagatatcaaaaaggaatgttaccatccctcatgctaatccttttcattttaaatcaacaggatctaaaaaaaataatgctgggaagtcctaaccacatcaagaatgtctcagatcagtgacccaaggaccttccagaatggatgaaatagacccaaagctgaattcacct

SEQ ID NO: 35253 - DNA, 158 bp, Homo sapiens
atctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagctt

SEQ ID NO: 35254 - DNA, 367 bp, Homo sapiens
attccaggtggacaaatgttgtcctgttaatttataggagttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttgg

SEQ ID NO: 35255 - DNA, 301 bp, Homo sapiens
ggaggaacagtgtgtccagcatgggagagttcatgagacgatgaagcaaagagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgaga

SEQ ID NO: 35256 - DNA, 306 bp, Homo sapiens
  misc_feature 15, 33, 303, 304: n = A,T,C or G
caagctcagcggaancaagttgaactataccangtgtatgcaatcagcaaattccagattgtgagaaagccaaacagccttggttctttaacagatattttgtgtggaaaagaaacagaagaagaccatgtagaaaaaaataaaaatgatttaaaaggctcatcagactttaatgggcaagactgagaaatatgtgtttaatagttgatttattcttctctgggaaaatcttatagaaaactcaggtaagataaatggcatatataatatctagatattgagggacttttttttttttttagnnct

SEQ ID NO: 35257 - DNA, 298 bp, Homo sapiens
  misc_feature 7, 14, 39, 42, 288: n = A,T,C or G
aagcacnccaaacncatccgaaaacagccagagactgcngcnactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactnaaagaatgtg

SEQ ID NO: 35258 - DNA, 354 bp, Homo sapiens
  misc_feature 14, 27, 48, 49, 56, 60: n = A,T,C or G
taaagaaatgcggnaagtaaatttatnaatagaaacaaaagtggccannatccacngggngacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatgggg

SEQ ID NO: 35259 - DNA, 248 bp, Homo sapiens
  misc_feature 6: n = A,T,C or G
ggaggntttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaat

SEQ ID NO: 35260 - DNA, 358 bp, Homo sapiens
  misc_feature 31: n = A,T,C or G
aaggcttagcatttaagtagcaacattgcgnttttcagacacatggtgaggtccatggctcttgtcatcaggataagcctgcacacctagagtgtcggtgagctgacctcacgatgctgtcctcgtgcgattgccctctcctgctgctggactcctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttg

SEQ ID NO: 35261 - DNA, 466 bp, Homo sapiens
  misc_feature 30: n = A,T,C or G
ggcagctcggcggtcccgcgggtctgtctnttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatga

SEQ ID NO: 35262 - DNA, 370 bp, Homo sapiens
ggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaaagtagacattctcacataagcccagttcatcaccatttcctcctttacctttcagtgcagtttcttttcacat

SEQ ID NO: 35263 - DNA, 440 bp, Homo sapiens
  misc_feature 31: n = A,T,C or G
gatgtgttgaacctctacctgttaggtgtgntactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtggggtggatcacctgaggtcaggagttcgaga

SEQ ID NO: 35264 - DNA, 161 bp, Homo sapiens
attgccatgaaggaaataaaaaagtctctatttaaattcttttttaaattttcttcagttggcgtgtttttgggatgtcttatttttagatggttacactgttagaacactattttcagaatctgaatgtaatttgtgtaataaagtgttttcagagcatt

SEQ ID NO: 35265 - DNA, 267 bp, Homo sapiens
aagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 35266 - DNA, 318 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggcagcatctgcaaagggacgtcagacaagtgcagctgctgtgcctgatgccaggacagctgtgctctcagatgtaaatagagcaacctatataaacctggatttttt

SEQ ID NO: 35267 - DNA, 342 bp, Homo sapiens
  misc_feature 23, 184: n = A,T,C or G
gattgcaaaggagaaaatagatnagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtngataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcagga

SEQ ID NO: 35268 - DNA, 264 bp, Homo sapiens
tgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactat

SEQ ID NO: 35269 - DNA, 332 bp, Homo sapiens
gttggagctggatcctatggcctgacccttaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttccc

SEQ ID NO: 35270 - DNA, 369 bp, Homo sapiens
gattccggaaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgaga

SEQ ID NO: 35271 - DNA, 411 bp, Homo sapiens
ggaggcagggcgcggtggccgtacagtccgtgccccagcggaagctttagcttggaccttatgcagtcggagggattagcatatctgggcagaggggtgagggattgcttcgaaaggatttcctaaagagataaaatttgatgctgggactctccttcttagtacacaccgactgatttggagagatcagaaaaatcattgttgcatggccattctcctttcccaaattgtgttcattgaagaacaggcggctggaattgggaagagtgccaaaatagtggttcatcttcgcccagctcctcctaacaaagaacctggcccattccagagtagtaagaactcctacatcaaactctccttcaaagaacatggccagattgagttttacaggcgtttatcagaggaaatgac

SEQ ID NO: 35272 - DNA, 324 bp, Homo sapiens; identical to SEQ ID NO: 34051

SEQ ID NO: 35273 - DNA, 354 bp, Homo sapiens
aagatgaggcaatactgaccttattggtgaacagattactccttctacaggtttgaaaaagctcagcaaatcccaaagggcccaggcctgcaggagaaactgccattcaaagaataatctgtactttttttaagacagcaaattatgagttgaacaatgagaacatatggacacaggaaggggaacatcacacactgaggcctgtcagtgggtggggggctaggggagggatagcattaggagaaatacttaatgcagatgacgggttgatgggtgcagcaaaccaccatagcacgtgtatacctatgtaacaaacccgcacgttctgcgcacatatcccagaacttaaagtac

SEQ ID NO: 35274 - DNA, 418 bp, Homo sapiens
  misc_feature 30: n = A,T,C or G
ggacgggtcctccaagagtttggggcgcgnaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttattgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattga

SEQ ID NO: 35275 - DNA, 152 bp, Homo sapiens
atcctagcaggggatcgaaggatgggtaaattagtgatgggtgacaaaaatctcaccttccatgacttaccttttggatggcaggctctatatggaagcggctataaaagtactcaagatatgtgagtatagaatttctttgtaaaaccaca

SEQ ID NO: 35276 - DNA, 469 bp, Homo sapiens
  misc_feature 6, 12, 30: n = A,T,C or G
attctnaaattntatgaaccaaaaagaacntaatagccgaaacaatcctaagcaaaaataacaaaaccagaggtattatactacccccatttcaagctgtactgcaaagctgcagtaaccaaaacagcgcggtaccgatataaaaacagacacatagaccagtggaacaagattgagaacccagaaataaagccacacacctacaaccatctgatcttcagcaaagtcgataatagcaagcaacggggaaaggactccttattcagtaaatggtgctggggaaactgggtagccacatgtagaagattgaaactggaccccttcctttcaccataaacaaaaattaactcaaaatggattaaagacttaaatgtaagacctcaaactataaaaccactggaagaaaacctagcaagtaccattctgggcattggccttatcaaagaatgtatgaccaagtccccaaaac

SEQ ID NO: 35277 - DNA, 231 bp, Homo sapiens
  misc_feature 206, 217: n = A,T,C or G
ggagatactgatataaggcattattttttgcaatgttgaatgtgttttttagtttgattctttttttttcccctaatagggcactacctgccatatcatcttgtattactttttgatgtaaagcgactaatatttacactatgccatattttttttaattatagttgtaaattatgaaagatccttgaattttctacagatctacnactactaatgnaacagacaagggca

SEQ ID NO: 35278 - DNA, 179 bp, Homo sapiens
  misc_feature 6: n = A,T,C or G
gaacgncaaaatgaaatgctagaactgccgttctttggatcgccactctatgggggtctgtcttttaactaccctcctggttatgttggccttacaccactgccatttgatttaaaacgctgcagacactttatctgcaaatgtgttccagttgttatcagctacctactacgcagctt

SEQ ID NO: 35279 - DNA, 240 bp, Homo sapiens
  misc_feature 30, 184, 218, 229: n = A,T,C or G
agaccgaagtgagcgacacactctgcgttntcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgagtttattgnaaaaagagaacatgcatgaacatcaggcacgatnaaagccatgtngagtggcccat

SEQ ID NO: 35280 - DNA, 102 bp, Homo sapiens
  misc_feature 1, 31: n = A,T,C or G
ncagcaggagtcaacaaatttgggattttanaagggggaggagggagctatttgtgtaagactgctgtcatatttgactacatattaaaaacagtaaatgag

SEQ ID NO: 35281 - DNA, 159 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcg

SEQ ID NO: 35282 - DNA, 257 bp, Homo sapiens
  misc_feature 5, 23: n = A,T,C or G
aagantgggaagaaggacaaggnatgttcactcggcactacttctattcagcattgtacttgaagttctagccacagcagttaggttaggaattcaaggtttgttcaacatctaaaaatcaaataagctaataaagaaaagaggtttatactgcaaaagaagtgaaactatatgtattcacagttgatacatagttgtatatagaaaatgctaaagaatccataaaaagtaataaatgagttcaacaggttgcagct

SEQ ID NO: 35283 - DNA, 101 bp, Homo sapiens
  misc_feature 92, 99: n = A,T,C or G
cgaggggtatgtgccatcacaagcagatgtggcagtatttgaagccgtgtccagcccaccgcctgccgacttgtgtcatgccctacgtgggnttaatcnca

SEQ ID NO: 35284 - DNA, 254 bp, Homo sapiens
aacaaaaaaaatttaactcctatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatg

SEQ ID NO: 35285 - DNA, 325 bp, Homo sapiens
  misc_feature 5: n = A,T,C or G
gaccncgctcttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttt

SEQ ID NO: 35286 - DNA, 283 bp, Homo sapiens
  misc_feature 83, 113, 117, 170, 182, 230, 258, 260: n = A,T,C or G
ataacaaaataccatagtccggctggcttataaataactgaatttttttttttctcacagttctggaggctgggaagtccaanattcaggcactggcagatttaatgtctagngagngctcacttccttgttcataggcagctgtcttttgctgcatcctcaaatggcanagggggcttganacctctcttgggcctcttttataagtaggattaatgcccttataaaanaggcccaagacagattgtaaacattcananaatagtacccagtttccttattt

SEQ ID NO: 35287 - DNA, 240 bp, Homo sapiens
agctgccgaccatcaggacgcctgcagacatttacagagcctttgttgatgttgtgaatggagaatatgtccctcgcaaatccatcctgaagtctcgaagtagagagaatagtgtgtgtagtgacactagtgaaagcagtgctgctgaatttgatgataggcggggagttttgaggagtatcagctgcgaagaagccacttgcagtgacaccagtgagagcattttggaagaggaaccac

SEQ ID NO: 35288 - DNA, 280 bp, Homo sapiens
aggaacaagcatgatcttgttactgtgatattttaaatatccacagtacttactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 35289 - DNA, 359 bp, Homo sapiens
gggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatg

SEQ ID NO: 35290 - DNA, 352 bp, Homo sapiens
attgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataaccctgttgtctaaattttatgtacagtcttttataataaaccattct

SEQ ID NO: 35291 - DNA, 441 bp, Homo sapiens
  misc_feature 5: n = A,T,C or G
tactnacaagtggcagaactaggacttgaactaaagtcctttttgtcaacagtgtctgtaggctgacctgttgggctctattgtttccctaatgaagagataggaaacctcagggaaaaaacttaagaagtgaaaaatgggccgggtgcggtggttcatgcctgtaattctagcactttgggaggctgaggcgggtagatcacttgagctcaggagttcgagaccagcctgggcaacatggcaaagccctgtctctactaaaaatgcaaaataaataaataaataaaaattagccaggggtggtccgtgcgcacctgtaatcccaactactgaactacgggggaggctgaggcacgagaattgcttgaacctgggaggcagaggttgcagtgagccaagatcacgccacttactccaccctggatgacagagtaagactct

SEQ ID NO: 35292 - DNA, 349 bp, Homo sapiens
gatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaagtttttaaaatcagtactttttaatggaaacaact

SEQ ID NO: 35293 - DNA, 174 bp, Homo sapiens
cattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtg

SEQ ID NO: 35294 - DNA, 414 bp, Homo sapiens
  misc_feature 19: n = A,T,C or G
atggcagcctttctttatnaacctaacccataagcctgctgcatttaaggtcttaatgcaatttgagaatatttctagtagtagaatagtacaaaagctaagatttgttttattccttttctttgtgttatagataactttgaatttaattctatctggagaggaaaaggtgaaaatcaaatttcccaccaaaaggaactagtattcctttgagaagggccagctaagcttgggggcagcaaatgtacaggattggtcttagacatattttactggagagcagggcagcagtggtgtcccagaacagccttttatcagagataaaaacttcattacttcataatgatactcccaaaaagcttattggtcatttttggagtttgctcaggtatgaactcagtcttccaaaagttg

SEQ ID NO: 35295 - DNA, 339 bp, Homo sapiens
  misc_feature 25: n = A,T,C or G
ccggcggtgacgacctacgcacacnagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 35296 - DNA, 397 bp, Homo sapiens
gaacttgacttcaccttgcgccctacaatgatgtaacatcccgtctattttgtcccacagtgtgacccttacataaaaataacactgggcaaaaaagtcattgaagaccgagatcactacattcccaacactctcaacccagtctttggcaggtaatatacattcttaaatgtttttctggccttcatttctccacggaacatgcatgaagactctaatatgtgtccaaccctgtcctaggctctgaaactgtgtttgtgaactagataaacattctagacaggggagcaggtaataaatagataaacccaaaataaaagaacttcacagaagtgaagaagcttggttctgatagcttgcagggtagacagacagcattagtactagtgttatagga

SEQ ID NO: 35297 - DNA, 146 bp, Homo sapiens
  misc_feature 12: n = A,T,C or G
aacaacaggacnagcgatggctctccctgctggaggattctggaagtcacctggctggaccaagccctctccgtgttctctgtcagcccactccccagagccgctaggcctgatgtgcacaagcagactaataaaggcttgaggac

SEQ ID NO: 35298 - DNA, 280 bp, Homo sapiens
atttttagaacaatatctgcttctgtgtgtttttggtttcaaaaagtttataaaattaatctagagatcagaagttctaaaaagcttaaaaagtgaaaatacgaatttgtaaatgaatatccaacaatctgtcaggagtcccatagagggggcacctttctaagacttggagctttttatgttacgttttatgtttttaaaatatgaggtaatttataaaaggtgaaaacttttgagtttctttgtaatggcatgaaaagcatgtgttgtttggaagggt

SEQ ID NO: 35299 - DNA, 385 bp, Homo sapiens
gagggtcttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttacccggttgattgaaatatcagtt

SEQ ID NO: 35300 - DNA, 266 bp, Homo sapiens
tatggccgggaaaggtaaaataatttgtcctgttcatactgatcatgaatggaattaaaagggattaaatgaaacttgaacccagttttctggctttaaatcaaaacttttgtctataaatacattgtggggactgggaggtggagatgagtagtggcaaaggcactgaattgataaacaatgagtagattctcaatttggctggaatattgggaccataagaagagaactaatgagtaataaatgaagattatattagagcagct

SEQ ID NO: 35301 - DNA, 309 bp, Homo sapiens
tggatcaggaagccaaacttaagaaagagcttgaaaataccgctctagagcttagtcagaaagaaaaacagtttaatgccaaaatgctggaaatggcacaggctaactcagctggaatcagtgatgcagtgtcaagactggaaacaaaccaaaaagaaaaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaac

SEQ ID NO: 35302 - DNA, 468 bp, Homo sapiens
caaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcctcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttggag

SEQ ID NO: 35303 - DNA, 336 bp, Homo sapiens
  misc_feature 333, 335: n = A,T,C or G
ggaattcagtatatagcaaagaggtattttagatcactggggagaaatagttgacctaaataaccagcttttggttaattacttctttactttgtggggaaaaaaaagctatatctctataccatattatataaaaatacatttccagtggattaaatatgtaaatgacaaaaaaattatgaaactactaaatagagaaatatttttgtttgtttgttttttgagacagtcttgctctgttgccaggctggagtggaggttgcagtgagctgagatcacgccatggcaacagagcgagactggcaacagagcgagactctgtccttccccacncnc

SEQ ID NO: 35304 - DNA, 119 bp, Homo sapiens
  misc_feature 31, 32: n = A,T,C or G
attgaaataaaaaataaaatcaaaaaaatannatttaaaagcttagcaaaatccaaagatacacacatacacgtatacatatatataaatgaaaccatagatacctcctaattaaactg

SEQ ID NO: 35305 - DNA, 464 bp, Homo sapiens
gactgtgctcaccagtaaaagaaacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcat

SEQ ID NO: 35306 - DNA, 285 bp, Homo sapiens
  misc_feature 6, 283, 284: n = A,T,C or G
ggctgnctcagttgtgccagggcttgggtgagggttacttcttccctcctgctgcctactgtgttttagcagagtctgatagaaacaaactcgattactcgcttagccaaactgagctagaaggcctgtattgtggaagaatccccagcatcatccttcaaaagtgaagctgggccaggcgtggtggcctgctgcaaatcccagcgctttgggagggtcacttgagtgcaggagttcaagaccagaccgggcagtatagcgagacctcatctctacaacatcnnt

SEQ ID NO: 35307 - DNA, 299 bp, Homo sapiens
cgtctgcgaaatctatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaat

SEQ ID NO: 35308 - DNA, 449 bp, Homo sapiens
  misc_feature 31: n = A,T,C or G
gtctctcaacactgaacaaatgttaaatcantagcaaataaagaaaaatgggtatatgtttttccctaggtggtttgtgatgaaaatggttccaagggctatggatttgtacactttgagacgcaggaagcagctgaaagagctattgaaaaaatgaatggaatgctcctaaatgatcgcaaagtgtaagttataaatatctagctaatcatattttgaatcttatttttaataattccaaatccattcattttaagttaatatttgtcagggagaagttagatgcacataagataaaagaataaaaacattttaaagatgaataacaaaaattcatgtagttgtactggagtgaaaattaataagctaatcttgatttttacaattgaattttctacacagtaagtgtaacatacaaataacaggtttaatataattaacattcatgc

SEQ ID NO: 35309 - DNA, 412 bp, Homo sapiens
  misc_feature 41: n = A,T,C or G
atggccggcattcacaagtaaggtggcccggaaccatcggnatttctgtggatccgaggaggcggaacaagtccacggagtccctgcagaccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctgggggcttgga

SEQ ID NO: 35310 - DNA, 156 bp, Homo sapiens
  misc_feature 31: n = A,T,C or G
gggggctggaacccctccccgggaagagtgncatctgggtcttccatctagaactgtttacatgaagataagatactcactgttcatgaatacacttgatgttcaagtattaagacctatgcaatattttttacttttctaataaacatgttttat

SEQ ID NO: 35311 - DNA, 439 bp, Homo sapiens
gtctttttttttgaggaagacgcggtcgttgggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccat

SEQ ID NO: 35312 - DNA, 141 bp, Homo sapiens
attctaggaggagcatacttgtacaaatattttgcacttcaaccagatgacgtgtactactgtggaataaagtacatcaaagatgatgtcatcttaaatgagccctctgcagatgccccagctgctctctaccagacaatt

SEQ ID NO: 35313 - DNA, 371 bp, Homo sapiens
  misc_feature 31: n = A,T,C or G
gggttgtcggattttagaggaaggcgctcgnttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaaga

SEQ ID NO: 35314 - DNA, 453 bp, Homo sapiens
  misc_feature 24: n = A,T,C or G
atttttgtccccagggacttcggntttatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaat

SEQ ID NO: 35315 - DNA, 141 bp, Homo sapiens
aagaggtggccttcatggtagagcttgacccaagaactactccacattcggatggcccagactgactccatcccctgactttccctttgacttcaccctgtttgtaaataaaacaataaaatggaaggtgctgtggactgg

SEQ ID NO: 35316 - DNA, 387 bp, Homo sapiens
catgaaagagcaattattttattgctcatgattctgtggttcaggtgtgtaggcagggtacaggtcatccctgtcccaggatgtctggagccttggctggaatagctcagttggctggaaacatcctggcttggctggggccctaagtctgagccctcattttttttgtctgcatagtgtctgctggatgtcaaacatccacgatggctccctcactcacatatgtgtctgttcacttgggctgagagagcaggaacagctgagggctgctggcacagttttctttccatgtgatcttcctcatggctagcccagggtggtccttgggtaattggacttcttacacggcagctgtctttcctcagagccagtgttttgagagactga

SEQ ID NO: 35317 - DNA, 398 bp, Homo sapiens
  misc_feature 6: n = A,T,C or G
gtttgnagaaacctcaatggtggcttccatttcagctatggagatgacaatctggctcccaacactgccaacgtccagatgaccttcctacgcctgctgtccacggaaggctcccagaacatcacctaccactgcaagaactgcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacat

SEQ ID NO: 35318 - DNA, 391 bp, Homo sapiens
  misc_feature 30, 384: n = A,T,C or G
caggctgcagtgcattggtgccatctcggntcactgcggcctctgcctcctgggctcgggtgattcacccgcctcagcctcctgagtggctgggattacaggcacccaccacaatgcctggttagtttttgtatttttttagtagagctggggtttcaccatgttggctaggctggtctggaactcctgacctcaggtgatccacccaccttggcctcccaaaatgctgggattgtagacatgagccactgcacctggccaagaacatgagtggctttattaatatgagacaaaatagacactgaggcaaaaactgttaacatacataaagatggccattttagaatagtaaagatagcagaataacagaatatatcaatgatntagaaga

SEQ ID NO: 35319 - DNA, 223 bp, Homo sapiens
ggggaccttggcgctctcagctttccctgcccatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgt

SEQ ID NO: 35320 - DNA, 198 bp, Homo sapiens
  misc_feature 17: n = A,T,C or G
tatggcctcaacatagngagaccccatctctaaaaaaaaaatttaaaaattagcgaggtatggtggtgcacacctgtagtcccagctataggggaggctaaggtgggaggatcacttgagcacaggaatttgaggctgcagtaatttgtgatcatgtcactgcactccaggctgggcgatagagggagaccttgtctc

SEQ ID NO: 35321 - DNA, 299 bp, Homo sapiens
  misc_feature 13: n = A,T,C or G
ggcatcactgagnaaggttgttttcgagcatacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactgggcaacctgcaaggagctggccagccaacctgatgtggatggcttccttgtgggtggtgcttccct

SEQ ID NO: 35322 - DNA, 403 bp, Homo sapiens
gttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcatttttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtga

SEQ ID NO: 35323 - DNA, 241 bp, Homo sapiens
  misc_feature 19, 33: n = A,T,C or G
ggcgacaaacctaccgagncctggtgatagctngttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacca

SEQ ID NO: 35324 - DNA, 135 bp, Homo sapiens
  misc_feature 9, 22, 35: n = A,T,C or G
ggaaccggnaaagcccgccagnaaaagaaaacatntacaagccccccacccgagaaatctggggatgaagggtctgaagatgaagccccttctggggaggattaaaagtgatgatggtctggggagagattttat

SEQ ID NO: 35325 - DNA, 221 bp, Homo sapiens
  misc_feature 7: n = A,T,C or G
tgaaaancaattaggcatgagataggaaggtaaaacttgggagagatattatagaattagaagggttggaatggagctcattcatcatggctgatgaagtaaactgatgaggtggagagagacagagtcaaggcaaggccaaacgaaaagatcttccatcccactcttcagtttcttgcgaagtttttcttgattccgccaatccacacagtttcctttat

SEQ ID NO: 35326 - DNA, 125 bp, Homo sapiens
  misc_feature 6: n = A,T,C or G
gacctncactatgagaagcgctaaagaaagttctttaggacgggcacgatagctcacgcctataatcccagcattttgggaggccaaggtgggaggattgcttgagctcggaagatggaggctgc

SEQ ID NO: 35327 - DNA, 264 bp, Homo sapiens
  misc_feature 30, 44: n = A,T,C or G
ggtaaataggctttacaggctcccctcctncaaacacacacagnaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaac

SEQ ID NO: 35328 - DNA, 308 bp, Homo sapiens
atattagtctgcggaagcagaagtccagttggaagttggctgtgagaaggaaacaggtgaagaagcaagatgcatttctgtcttttttgggattttatatcctgtgtatatgtgtatgttgtgtattcgtgtatgtgtgtatatgtgcttttactgtattttcctgcatcgtgtatatgtacatatgtacctgtatattcatgcattgtgtatatgtgaatgttgtatatctatgcatgtgcgtatgtgtgccatatattaatgcatatgtgtatttttatatgtcatgtattcactcgtgtgtatat

SEQ ID NO: 35329 - DNA, 316 bp, Homo sapiens
  misc_feature 176, 177, 178, 288, 292, 306: n = A,T,C or G
aacaacctttgagaatggacgctccatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggnnnatgccatcggcaccgtactggatcctggccaccgactatgagaactatgccctcgtgtattcctgtacctgcatcatccaactttttcacgtggattttgcttggatctnggcnagaaaccctgggtntgcctgcgga

SEQ ID NO: 35330 - DNA, 366 bp, Homo sapiens
  misc_feature 24, 30, 31, 32: n = A,T,C or G
gtctgcaaaattgtaatttgaatnagattnnnctgaaatactcctctaactttcttttggttagagatttatttcttgtttttaaaaaaatgacttaaaatgtgtctaatacttcccagactttaatttgcatctgtattcagtatcagatgttttgtattttcgaggctgaaaagaaatttgtaactttttcatatgccacatactactgacttctacttttaaacagaattggatgacatctcccaattgcttgtgcctaccatatatttaaaatggttttactgagaaccacccccctgccccagggagtatccacatgtaatgatcttcctgctagatttgatgttatgccggtatatactg

SEQ ID NO: 35331 - DNA, 165 bp, Homo sapiens
  misc_feature 30: n = A,T,C or G
gggtgcaggatgaggaattgggtagaagcntgatatgggatgaggaattgcttaacgggtacaatgtacattactcgtgtgatggttacactaaaagctcaaacttcaccactatgcaatatatccatgtaacaaaactgcacttgtaccccttaattttatacg

SEQ ID NO: 35332 - DNA, 279 bp, Homo sapiens
  misc_feature 31: n = A,T,C or G
gggaggggtcctgaggtgacagcgcctgctnctgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctaga

SEQ ID NO: 35333 - DNA, 413 bp, Homo sapiens
  misc_feature 30, 31: n = A,T,C or G
gggacctctggtggacatggctgcttcccnnttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggtgagaacaaaatcatggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtg

SEQ ID NO: 35334 - DNA, 468 bp, Homo sapiens
cacttcacccactccactttcctccacagtatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagtactttctgcattccaaacagcatcctacctgggttttttat

SEQ ID NO: 35335 - DNA, 244 bp, Homo sapiens
tggtgcaagtagtgattggagaacaaagaggtgaaggagtattcatggcttctcgctgtttctgggatgctgacactgacaactatactcatgatgttttcatgaatgacagcttattctgcgttgtagcagcatttggctgtttctactactgaatgaatctttgaaaagctggtaaaagacatgaccatgaagaaatctgaactttttaatattgttaaatatcttgacaaaataaagatgt

SEQ ID NO: 35336 - DNA, 234 bp, Homo sapiens
  misc_feature 31, 32: n = A,T,C or G
ggcaggcagatgaccggaaggttgggagttnnagaccagcctgaccaacatgacaaaatcccatctctactaaaaatacaaaaattagcagggtatggtgacaagcacctgtaatcccagctactcaggaggccgaggcaggagaatcacttgaacccgggaggcggaggttgcagtgagccgagatcacgtcattgcactccagcatgggcaacaagagtgaaactccatctc

SEQ ID NO: 35337 - DNA, 281 bp, Homo sapiens
aaggatggaactaacaggaatcttaaaaaaggtaggaatggaacaattagatttgttcttaagaaacaactagtagtaatgtagaagaaggttttgagtagggaaagcctcagaaaaagactgtttaagaaggtcttgtcttgatgcagtggttcatgcctgcaatcccagcactttgggaggcctaggcaggaggatcgcttgaatccaggagtttgaagctgcagtagccatgatcacgccactgcactccagcctgggtgaaaacctgtcccacacac

SEQ ID NO: 35338 - DNA, 403 bp, Homo sapiens
  misc_feature 5: n = A,T,C or G
gttgntttatgcgtgctgcagcagtgggcttaatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggaga

SEQ ID NO: 35339 - DNA, 317 bp, Homo sapiens
  misc_feature 18, 117: n = A,T,C or G
caattgtgtcactttgtngaagcattaataagcttggatggcgacagcctgacccctttatcgtcagtttcccctcaactgttcccctgacagttttgccacctgtgggtgaccatntgctagaaccagaaccttcactgggactgcagaattctcgtcttctgtctcatcagaaggacatttagtggctggaattctctcagaccttccctttatccattagggtaagtcaggttaccctgaagtgcgttcatactagaaaggcagcataagcacttaattatttccctttaatgatcaatttttggagtaagaat

SEQ ID NO: 35340 - DNA, 283 bp, Homo sapiens
  misc_feature 32: n = A,T,C or G
aagggaaaagaagaaggggcgaactgcttgtnttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaac

SEQ ID NO: 35341 - DNA, 423 bp, Homo sapiens
  misc_feature 7, 58: n = A,T,C or G
atagcangctgcttatattaatttaagagaaatcctatatatcccattaaaaaaatcntagagaaacatttccagaatggtggagtatggatctttgaatatctgattctgcataaaatcagtgaggacactggcaggaatgatcaaaataaacttttttaaactctggaaattaaccaaacgattgcaacaacccaaagaaaatgtatttgagaaaaaagctgactttccgtgatcaataaggtttgtggtgttttaacttgtcctgtccccattttcttctcagctccacagtagccttgaaaatcagcaaccttgagaccacagtagctgtggcaaccagtagcctagaaaccactgaaggaatttagagtccccccaagataggttttggagttatccaagacgccccatccccagaga

SEQ ID NO: 35342 - DNA, 389 bp, Homo sapiens
aggaacaaggcttacttttcttgtatatactttagaattgttcaactttcccctccataaatgcattatatttataaagggaaaaagttactgacatttatttattgtgtgatattttaaagtgaccagaaaaatttgaaggtaaaagaagaaagagttctattttattttatgtttttcattttatttaatttaattactatttttttgtttgtttttgagacagagtcctgctctgttgcccagggtggagtgaagtggcacgatcttgtctcactgcaacctccacctcccagagtcaagcgattctcctgcctcaccctcccaagtagctgagattacaggcatgcaccaccacacctggctaatttttgtatttttagtagaga

SEQ ID NO: 35343 - DNA, 126 bp, Homo sapiens
aatgccccaactaaatactaccgtatggcccaccataattacccccatactccttacactattcctcatcacccaactaaaaatattaaacacaaactaccacctacctccctcaccaaagcccgc

SEQ ID NO: 35344 - DNA, 246 bp, Homo sapiens
cggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttat

SEQ ID NO: 35345 - DNA, 374 bp, Homo sapiens
  misc_feature 3, 10: n = A,T,C or G
aantcggccnttatggcccgggggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctc

SEQ ID NO: 35346 - DNA, 431 bp, Homo sapiens
attataattttttagaaaaaccaccatcgtgtcacgtcgacgatgccaaattatgttagcgtgagcagaaacaccgtgggggaggaaggcagcagctgaagaaaaaagctcaaataatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacgaaggcttatcaagtgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagga

SEQ ID NO: 35347 - DNA, 272 bp, Homo sapiens
gttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgc

SEQ ID NO: 35348 - DNA, 467 bp, Homo sapiens
atttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactggagattacctacctcccagtagtgaaaataataaatttat

SEQ ID NO: 35349 - DNA, 237 bp, Homo sapiens
gcgaggtggatttcctcctcgggacaggggtgcctgtatacacaaaggacttggtaagctatacatggggtgatggtataatgcagcatcaaactgagctgtttctgaaagtacaatgggaagctatttatttttccaagagaacaggtatgaactaggatggtcttaggcctcagggaaatctggtcaccctgactatatgactatatgtatctggtagtatcaataaaataaacc

SEQ ID NO: 35350 - DNA, 439 bp, Homo sapiens
  misc_feature 29: n = A,T,C or G
atctcaatagaagtaaaaactgtttgacnaaatctagcactctttcatgataaaaacactcaacaaactaggaacagaaggaaacttcctcaaagctgacaaagggcatctatggaaaagccacagctaacataatagttaatgataaaagctttctccctaagatccagaacaagacacggatgtttgccttcaccacttttattccacattgtactgaagattccaatcagggcaatcaggcaagaaaaagaaataaaaatcaacccgatttggaaggaagtaagacaatctgtatttgtagatgacataaatgtatgcatgaatatcctaaggaatctactacaaactattggaaataattaacaatttcaacacagtggcaggagaacagatcaatatacaaaatcaattgtatttctctatagcagcaatgaac

SEQ ID NO: 35351 - DNA, 365 bp, Homo sapiens
cactgagacgatgggaaagtagcaacaatactaggtgatttctttgatttaaacccaattaaaagaattagagagttgtctgatacaaggccaaagaactaagaacagaaacaaaagcaaaacaacaaacagcagcacaaactccagtgagataaatttttaaaacattgggaatatttaaaaaataaaaacactccaatgaaccacccaggttttattaaagagtagagaactcaaacagcagaaggcagagctggtggaggaaactcagcaactgctcagaaatgaaacaacctaggaaggaggtgcgagtgacctgaaactccttttaaaaacagaaaggacaaaaagaggtatgggctgac

SEQ ID NO: 35352 - DNA, 252 bp, Homo sapiens
gatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaattt

SEQ ID NO: 35353 - DNA, 425 bp, Homo sapiens
  misc_feature 351, 369, 397, 402: n = A,T,C or G
tatggccggggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctganaacaaatctttttcttanaaaaatctagctataaaattcttttcanactgnactgcctatgcttggaattggcc

SEQ ID NO: 35354 - DNA, 308 bp, Homo sapiens
ctggtcttgaactcctgacctcaggtgatctgcccgcctcggcctcccgaagtgccgggattgcgggcgtgaaccactgcgcctggcccaccattttaaacagagaaccaattccccattttttgtatccatttgctttatcttttttatatcttagaatatcaacctagaagctaggcacagtggctcacgcctgtggtctcagcacttttggaggccggggcgggaaggattgcttggggacaggagttcgagaccagtgtgagcaaagtatggagaccttgtctctgcaaggaatagaatagttg

SEQ ID NO: 35355 - DNA, 294 bp, Homo sapiens
gattgccctactcagaaaaagaacctggtgcaaaaagaagttgctgtgggtcagctttttcgtgcatttatgttaattggtaatagacacataaagtggtgtgtacaaattaccctaaaataagaaaactaaattggattgtacagaaattacatataatgaaacactggatttgctcagtgatgtatagttttataaccatatattaacatatgcatattacatatataaataatatatacaatataagtaatatatattatatatataatgagcctttattattgaaatgtc

SEQ ID NO: 35356 - DNA, 472 bp, Homo sapiens
agaatagcatagataaggacctgtggaatagaattaagagtccagaaataaattcatggatctgtgaccaattgatttttcataagtatgcaaagtccatgaatagaacaaagaacagtctctttaaaatggtattagaacatctagatttccacatgctaaagaatagtcatacctcctacctcacaccatagatccaaatgaactcaaaatgaatcaatgagctaaatataagagctaaaactataaaactcttaaaagaaaacgggtaaatcttcatgatcttttattagacattggattttcagatatggcaccaaaaagatgggcaacaaaagaacaataaactttggacttcattaaaattaaaaatttttgcataccgaaggacattatcaagaaagcggaaagacatcttacagaatgggagaaaatatttgcaaatcatgtatctgataggggattaatattc

SEQ ID NO: 35357 - DNA, 470 bp, Homo sapiens
tggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaac

SEQ ID NO: 35358 - DNA, 148 bp, Homo sapiens
  misc_feature 131: n = A,T,C or G
tacccttcagcatgattacaatgtatttacccttcagtattgattaccagaagtccctaccttgacaatcacatattagaaagaaccggtgctattcagtaagttctctttcctttcccttggagggaagncagcagagtcatcagtt

SEQ ID NO: 35359 - DNA, 428 bp, Homo sapiens
gtcggcggcttttggcatggcgactttttctggcccggctgggccaatcctgtcgcttaatccgcaggaagatgtcgagtttcaaaaggaggtggcgcaggttcgcaagcgcataacccagcgaaaataacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccat

SEQ ID NO: 35360 - DNA, 204 bp, Homo sapiens
actgttgacttttgctctctttggtttttatgccagagattgctaacccctggtttagaattgttactacaagcataaaatcatttatgggccgggcgaggtggctcacgcctatagtcccagcactttgggaggcagaggcaagtggatcgcttgaacccaggagttaagaaagcctgggcaacatggcgacacgcagtttct

SEQ ID NO: 35361 - DNA, 402 bp, Homo sapiens
caggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagcca

SEQ ID NO: 35362 - DNA, 372 bp, Homo sapiens
ctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatg

SEQ ID NO: 35363 - DNA, 433 bp, Homo sapiens
ggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaaagtggtcctggactacagactctgttgccttgaatataacagtacaatttgtcaattactctgcaccaggctaaaatgagtaaaatctttttg

SEQ ID NO: 35364 - DNA, 157 bp, Homo sapiens
  misc_feature 21: n = A,T,C or G
gggaactgcagttgctgctgnagctgaggtacagcggcggtttctgaggttcttcactcgcgactgacggagctgcggtggcgtctccacacgcaaccatggagttgaaggacacaaaatcaaggccaaagcagtcaagctgtggcaaatttcagac

SEQ ID NO: 35365 - DNA, 176 bp, Homo sapiens
tactaaacctgcattaaaaatttcggttggggcgacctcggaagcagaacccaacctccgagcagtacatgctaagacttcaccagtcaaagcgaactactatactcaattgatccaataacttgaccaacggaacaagttaccctagggataacagcgcaatcctattctagagt

SEQ ID NO: 35366 - DNA, 474 bp, Homo sapiens
  misc_feature 29: n = A,T,C or G
gtagaagagtatatgattgaacgaccagnagccagaattccaagacctaaacgaaaaggcacgagcacttaaacaaattctcagtaagatcccagatgagatcaatgacagagtgaggtttctgcaggcaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttccgtaagtgccaaccgactaattcatcaaaccaacttaatacttcagaccttcaaaactgtggcctgaaagttgtattggttaaagaagatgtacttctcagtggcagtattgaactgcctttatctgtaaattttaaagtttgactgtataaattatcagt

SEQ ID NO: 35367 - DNA, 363 bp, Homo sapiens
attgatggacatttaggttggttccaagtctttgctattgtgaatagtgccgcaataaacatacgtgtgcatgtgtctttatagcagcatgatttataatcctttgggtgtgtatccagtaatgggatggccaggtcaaatggtatttctagttctagatccttgaggaatcgccacactgtcttccacaatggttgaactattttacagtccaccaacagtgtaaaagtgttcctatttctccacatcctccccagcacctgttgtttcctgactttttaatgatcaccattctaactggtgtgagatggtatctcactgtggttttgatttgcatttctctgatagccagtgatgatgagc

SEQ ID NO: 35368 - DNA, 447 bp, Homo sapiens
  misc_feature 13: n = A,T,C or G
attgttaagcacnggataatagaattaattatcttgtataatgtttaatcacagtattgaaaatataaaacggggatagaattgaaaagcttgaattctaaggcagatttacatcactttctcatgattcaggcttatatatactgcaccaagcagttctgtgactgtgttttattgtatttgatataaccatctaaaaattggcacttttaataatatactcagacaataatgtggcttaaaacttaaactaattggctgctctgtaggccagtctagtttttgaaaggtttgagatgtaatttctgaaaaaattgctgtggaagagaaagcctatttgccaccccaacctgagttcttgctggtggaaggaggctcctccctctccttgctgctccaagttaggtagaacaacatgactggacacaggctctagctggtgggaac

SEQ ID NO: 35369 - DNA, 148 bp, Homo sapiens
gaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaact

SEQ ID NO: 35370 - DNA, 465 bp, Homo sapiens
ggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggtggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatg

SEQ ID NO: 35371 - DNA, 118 bp, Homo sapiens
agcctaacaaaagtttggagactggaatcctactttgagccctgacttgaaataactcttttggcaagttgcctgacatcctgtcttaccaaggtggcatatttgcatttttactgct

SEQ ID NO: 35372 - DNA, 413 bp, Homo sapiens
gattgatgtcagtgtctacatatctagatatattgaaagccatggatttggaattactccagttccactctaatgtcccagggttctgtgtagcctccctgctttgcatatttgtaactctctttaacaatgagaaacatggttctcaacatttactatatagctactttttaacttatttctttaatacacatgaagtaagttcagcattgtaagtctatggcactttgataaataaacctactaactaaagtacaatgatggtttatagtttttctgtctttagccagagggaatattgtccaaatactgtgttaaaatgttatttgagcttgttttttcctctcttcactgcagttatgtttttcatttgcaatccagttaggtttactcatttttactttggttatatg

SEQ ID NO: 35373 - DNA, 329 bp, Homo sapiens
atgtgttttcccactatatttacacacttacaggatctactgtatagctagttaatgtgaagaaccaggtaaatgcaatgctgctactcttctgtttctaagagcgtataatcttataaaaccaattttaagtgaataaatcaaattgaatggctataaaaggacttttttttagcatggggttctatgtatttttttgtctttttttaagctaatagtctttaagtaactgtccatgatcacgtacatttactccatagttaagactttagacatttctaaaatgagggattacaaaacatttttagttgacgatgaaaatgttgaat

SEQ ID NO: 35374 - DNA, 118 bp, Homo sapiens
aacgatttctggctagtgccacgaggtttacttgactgttgtgtgaaaagctgataagaaaaccatccagaaaaaagctcttcgttttacaaacatgaaaataaaacatgtaattttg

SEQ ID NO: 35375 - DNA, 326 bp, Homo sapiens
aggtctagaattggaacctgggaactaggtactttaaaaaatgctcttggttgcgctcatgcctgtaatcccagcacttcgggaagattgcttgagcccaggagtttgagaccagcctgggcaatatagtgagagtttgtcttcacaaaaaatgtaagaaaattagctgggcatggcggggcgcacctgtagtcccagctactcagtgggaggattgtttgagccccgaggttgaggctgcagtgaagtgagatcacacccagccctccaacctaggtgacagagcaagacactgaaacctagtttatgtgtgtggggtggggaga

SEQ ID NO: 35376 - DNA, 409 bp, Homo sapiens
gggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatgga

SEQ ID NO: 35377 - DNA, 125 bp, Homo sapiens
ggtgaccacgggtgacggggaatcagggttcgattccggagagggagcctgagaaacggctaccacatccaaggaaggcagcgggcgcgcaaattacccactcccgacccggggaggtagtgacg

SEQ ID NO: 35378 - DNA, 498 bp, Homo sapiens
  misc_feature 11, 14: n = A,T,C or G
acaccgggganttnggccttatggccggactcttaatgccctatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactc

SEQ ID NO: 35379 - DNA, 454 bp, Homo sapiens
  misc_feature 146, 157, 192, 203, 227, 258, 313, 440: n = A,T,C or G
tgcttcaaaaattttgtaaattgtttattttaaacttatctgtttgtaaattgtaactgattaagaattgtgatagttcagcttgaatgtctcttagagggtgggcttttgttgatgagggaggggaaacttttttttttctatanacttttttcanataacatcttctgagtcataaccagcctggcagtntgatggcctanatgcagagaaaacagctccttggngaattgataagtaaaggcagaaaagattatntgtcatacctccattggggaataagcataaccctgagattcttactactgatganaacattatctgcatatgccaaaaaaaattttaagcaaatgaaagctaccaatttaaagttacggaatctaccattttaaagttaattgcttgtcaagctataaccacaaaaataatgaattgatganaaatacaatgaaga

SEQ ID NO: 35380 - DNA, 146 bp, Homo sapiens
acagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacattt

SEQ ID NO: 35381 - DNA, 126 bp, Homo sapiens
gggaggctgaggtaggagaagcgcttgaacccgggaggtggaggttgcagtgagtcaagattgtgccactgcactccagcctggcgacagagcgagacacggtctcaaaaaaaaaacaacaccacc

SEQ ID NO: 35382 - DNA, 281 bp, Homo sapiens
gactcttagcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaggtggaatatttcctgaagtggaagggatttacagatgctgacaatacttgggaacctgaagaaaatttagattgtccagaattgattgaagcgtttcttaactct

SEQ ID NO: 35383 - DNA, 478 bp, Homo sapiens
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgcggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatgtccctgtttgggaccaagaattcctgaaagttggccaaggaacactttttgaactcattctggctgcaaactacttagacatcaaaggtttgcttgatgttacatgcaagactgttgccaatatgatc

SEQ ID NO: 35384 - DNA, 116 bp, Homo sapiens
caggttagtcttgtctctctgactcatgtcccaagttgcttccatagagatacctgtggcatcttttccccctttactctgttttcctgaatttccctctatttttcactgactac

SEQ ID NO: 35385 - DNA, 240 bp, Homo sapiens
gagatacctgaggtaggagttggagaccagcctggccaacatggtgaggccctgtctcaactaaaaatacaaaaattagccagacatgatagctgggactacagagacagtgtctcactgtgttgccctggctggtctccaactcctgagctcaagcaatcctcctgcctcagccttccaaactgctgggataacaggtgtgagccactgcgcctggcctcagagatgggtattttaaac

SEQ ID NO: 35386 - DNA, 392 bp, Homo sapiens
agtgaagctccagcctgggatgaattcatccattctggctttgcatccggctaccattttcgaagttcaactcaggaaggtgcaatataacaaatgtgcatattataatgaggaatggtactaccgttccagattttctgtaattgcttctgcaaagtaataggcttcttgtcccttttttttctggcgtgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatac

SEQ ID NO: 35387 - DNA, 336 bp, Homo sapiens
agctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaac

SEQ ID NO: 35388 - DNA, 137 bp, Homo sapiens
atcccagatggctgtggggtcaagtacatccccaatcgtggccctctggacaagtggcgggccctgcactcatgagggcttccaatgtgctgcccccctcttaatactcaccaataaattctacttcctgtccacgt

SEQ ID NO: 35389 - DNA, 198 bp, Homo sapiens
gtggagcctcacttttaatgaacaatggcctttattaaaaactgagtgactctatatagctgatcagttttttcacctggaagcatttgtttctactttgatatgactgtttttcggacagtttatttgttgagagtgtgaccaaaagttacatgtttgcgcctttctagttgaaaataaagtgtatattttttctat

SEQ ID NO: 35390 - DNA, 201 bp, Homo sapiens
  misc_feature 114: n = A,T,C or G
cagaaaggggtgtttctgtgggtactcctcttaccccagcaaataaaaggaattgtctgaccctagaggcagatgctgcactgcactactccaatgtcttccatggagcctcangtgctccccctctcacctggcagccccttcagctgctagtgatatcacttgttggacatttttccaataaaggttcttggacaaacc

SEQ ID NO: 35391 - DNA, 314 bp, Homo sapiens
gttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggata

SEQ ID NO: 35392 - DNA, 421 bp, Homo sapiens
attgaatcctgttgaaaaatctatccggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtg

SEQ ID NO: 35393 - DNA, 471 bp, Homo sapiens
ggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaag

SEQ ID NO: 35394 - DNA, 354 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatg

SEQ ID NO: 35395 - DNA, 307 bp, Homo sapiens
  misc_feature 27, 291, 300: n = A,T,C or G
gttttgattaatttttttccctcaacncccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttnccataaatngttttta

SEQ ID NO: 35396 - DNA, 205 bp, Homo sapiens
ggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttc

SEQ ID NO: 35397 - DNA, 158 bp, Homo sapiens; identical to SEQ ID NO: 29724

SEQ ID NO: 35398 - DNA, 160 bp, Homo sapiens; identical to SEQ ID NO: 27886

SEQ ID NO: 35399 - DNA, 344 bp, Homo sapiens
gctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 35400 - DNA, 472 bp, Homo sapiens
gacaaggccattacataatgctaaagggataaattcaacaagaagagctaactgtcctaaatatatatgcacccaatgcaggagcacccagattcataaagcaagtcctgagtgacctacaaagacacttagactcccacacattaataatgggagacttcaacaccccactgtcaacattggacagatcaacgagacagaaagtcaacaaggatacccaggaattgaactcagctctgcaccaagcagacataatagacatctacagagctctacaccccaaatcaacagaatatacatttttttcagcaccacaccatacctattccaaaattgaccacatacttggaagtaaagctctcctcagcaactgtaaaagaacaggaattataacaaactgtctctcagaccacagtgcaatcaaactagaactcaggattaagaatctcactcaaaaccgctcaactacatg

SEQ ID NO: 35401 - DNA, 341 bp, Homo sapiens
  misc_feature 331: n = A,T,C or G
gttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaaggatttaacattctcccatcccttaaaaaatatacatgggataaaatgaaaaccataataaatggnggggaatatg

SEQ ID NO: 35402 - DNA, 143 bp, Homo sapiens
gaagtggttaggttgagtgggtaggttggtttttaaaataccaacaacaaaaaaagatgctgttctaaaaacacaaacatttgaaggctgggtgatggatatagttttatatcaacgtcagcacacgctgtatttctatattt

SEQ ID NO: 35403 - DNA, 139 bp, Homo sapiens
ggatccgcgatgcgtttcctggcagctacattcctgctcctggcgctcagcaccgctgcccaggccgaaccggtgcagttcaaggactgcggttctatggatggagttataaaggaagtgaatgtaagcccatgcccca

SEQ ID NO: 35404 - DNA, 120 bp, Homo sapiens
  misc_feature 107, 111: n = A,T,C or G
atagacattctacataagcccagttatcaccatttcctcctttacctttcagtgcagtttcttttcacattaggctgttggttcaaacttttgggagcacggactgncagntctctggga

SEQ ID NO: 35405 - DNA, 311 bp, Homo sapiens
catctagcaaatcgaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggcatctagcaaatcaga

SEQ ID NO: 35406 - DNA, 249 bp, Homo sapiens
agtgagttaccctctaaataccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccc

SEQ ID NO: 35407 - DNA, 471 bp, Homo sapiens
catctccgctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtcattcataatga

SEQ ID NO: 35408 - DNA, 106 bp, Homo sapiens
gttaagaaacagttatgatcctaaactttttggataatcttttatatttctgacctttgaatttaatcattgttcttagattaaaataaaatatgctattgaaact

SEQ ID NO: 35409 - DNA, 425 bp, Homo sapiens
  misc_feature 413, 420, 423: n = A,T,C or G
gatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatnaagagtnctnct

SEQ ID NO: 35410 - DNA, 397 bp, Homo sapiens
  misc_feature 3: n = A,T,C or G
atnaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataagtacacctttttttccctcttccccctaaaaatggtaaatctgatcatatctacatgtatgaacttaacatggaaaatgttaaggaagcaaatggttgtaactttgtaagtacttat

SEQ ID NO: 35411 - DNA, 439 bp, Homo sapiens
aggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtc

SEQ ID NO: 35412 - DNA, 120 bp, Homo sapiens
aagttaaattcaatagaagaagtatgctaattagtacagaaaacttagagaaagtactaatttagttaagattaattctgttcttattttaattcaaaagatagatcaatttctgtttat

SEQ ID NO: 35413 - DNA, 198 bp, Homo sapiens
  misc_feature 51: n = A,T,C or G
atacttacgaaatgttaaattaaaaaatcagaatacacaattatatgtgcnttatgaggacatctcagtgaaaatatgcttacatggggacaaataatagattaaaatttttaaaaatgaaaagattgtgtttgggtaatgggataaatggtgtttttctggttaaaaatgtcatcaatgttttaagtgtttataagg

SEQ ID NO: 35414 - DNA, 192 bp, Homo sapiens
ggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaagc

SEQ ID NO: 35415 - DNA, 436 bp, Homo sapiens
  misc_feature 383, 408, 421: n = A,T,C or G
ggcgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtntcagacccgaagcgcaccattgctnaggattatggggncttaaaggctgatga

SEQ ID NO: 35416 - DNA, 457 bp, Homo sapiens
  misc_feature 19: n = A,T,C or G
gaatactgtatggtaggtnatgatttctcagtccagtgtcatatttaaacgatggtggtcatgtggtagtcagagcatttttaagactgctatcttactgttcccaaatgttttcctactgttaactgtccattgaccctcctttcttttttccatctcatactctgtaactattagagaaaatcatgggaacaaacctacactggaataaggagttttgagttctgctattagctagttgtaaggcatgggttaattaatctctttgattctcattgtctcatctttaaaataaagagatccattacattatctctaaagtcatttacactctaaaattttataataaaacacataagatcccttgatactataaaaataaaaaggcagataccagaacattacataagactctgatatccattttattaatatacatcttttgtgttttaagtga

SEQ ID NO: 35417 - DNA, 322 bp, Homo sapiens
  misc_feature 4: n = A,T,C or G
gacncgcttttatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttt

SEQ ID NO: 35418 - DNA, 127 bp, Homo sapiens
ggttataataaattgatgtcatgcccacagcacagcaggcaaaaaggatgaattagagacagaaatagtaatagggttttgtccaggaaacctcaagcatatgaggtattgccatgttgattacttt

SEQ ID NO: 35419 - DNA, 173 bp, Homo sapiens
  misc_feature 5, 173: n = A,T,C or G
gagtnaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgcn

SEQ ID NO: 35420 - DNA, 282 bp, Homo sapiens
ggaacaccacccagtgtggagcagcccagccaagcactgtcaggaatcctgtgaagcagctccagctatgtgtgaagaagaggacagcactgccttggtgtgtgacaatggctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggattcctgacccctgaaattaccc

SEQ ID NO: 35421 - DNA, 171 bp, Homo sapiens
atgtttgaatttatgagaaattgcaggactgcatgtgaatgtggctgctgtgaatgatgatgaacagaaagagaatgacaagttcaaatccctaacttcttgatttaagacacagaagaaaatctatgccctttccctgactatgctaaaataaaagcatactatctttct

SEQ ID NO: 35422 - DNA, 321 bp, Homo sapiens
aagagtaagaaatggcatccaaattggtaaagaggaggtcaagctgttgctgcttgctgatgatatgattgcttacctaaaaaaccctaaagactcctccagaaagctcttagacctgataaaagagtgcaacaaattttctggatacaaaattaatgtgcacaaatcagtagctcttcgatacaccaacattgaccaagcagagaatcaaatcaagatctcaaccccttttacaataactgcaaaaaaataaaatacttaggaatataccgaaccaaggaggtgaaagacctctacaaggaaaactacaaaacaccgccg

SEQ ID NO: 35423 - DNA, 268 bp, Homo sapiens
gtgccctctcggcattgtgcatgcactaagagccctcacaccccatgagctgagtactgtcctgcttcacacctgcatgggaatttctgagaggtgctaggaaggctgtacagtataaaaatgtctcccttctccatttgacaagtcgtgtttgttagtttagaattaccataatagtgttcctcaactagtctttaaggtgccctgaaaatagaaagaaagtaggagacagagggaaaaagggaggaaggaaagaatcagggaagga

SEQ ID NO: 35424 - DNA, 243 bp, Homo sapiens
gcttgtagtttctttggaagaaatagggacacccccacccattgccttctttggactgattaattcagccacatctgatcccaagcagaggatagttctaatctgtttttctgtttttgtttttgtttttgtttttgagactatctcaaaaaagaaaaacaatacccaaaaataaataagtagaatgattcaccaaaaagatacagcaactaatgagcttgaatgtacctaacaccaaattat

SEQ ID NO: 35425 - DNA, 359 bp, Homo sapiens
gatggcatcagggttcttcctagcaacgtggaagacactcctgccctcaagagggctaagtccagtaaaacccaaccaacaggagacagttgggcaggaagactcattctgagtgtagatggctctgggttttgtgagagggtgaaatctttggtcgttaaacaattctagctgccctagaatggtaaccccaagtcacttcagactggaaaagattttagtggctagaattaaacgtagagatggcaaaatacaccaaagccacagcattaatagacttgcatgaatttaggaataacctggaataattaatatttaaggcatttgcaatgctttaaggatgttgatattttaaaaga

SEQ ID NO: 35426 - DNA, 196 bp, Homo sapiens
gctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagcca

SEQ ID NO: 35427 - DNA, 377 bp, Homo sapiens
  misc_feature 327, 341, 354, 370: n = A,T,C or G
catgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctgctgatgatggtaataccacgcccagaaatcatggagttgatgatgatggcgatgatgatggcgatgatggcggcactgatggccccaggcacagtgcaagtgatgactacttcatcccaagtcaggcctttccggaggccgagagagctcaatccattgcctatcacctnaaaattgaggagcnaagagaaaaagtncatgaaaatgaaaatntagggac

SEQ ID NO: 35428 - DNA, 100 bp, Homo sapiens
  misc_feature 96: n = A,T,C or G
ggggcattcctgaagctgacagcattcgggccgagatgtctcgctccgtggccttagctgtgctcgcgctactctctctttctggcctggaggctntcca

SEQ ID NO: 35429 - DNA, 366 bp, Homo sapiens
gctttctgggctcggacctaggtcgcggcggcatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatg

SEQ ID NO: 35430 - DNA, 470 bp, Homo sapiens
  misc_feature 10: n = A,T,C or G
gctttttttnggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgcc

SEQ ID NO: 35431 - DNA, 427 bp, Homo sapiens
  misc_feature 393: n = A,T,C or G
gatacaagaggtttacacttacagaagcaagtcgtagagtactatttctcagtggaagtcacgtgcattggagtcacatgggctaattatgaagtgcagactgtcatacacctggtaaatcagaacctttggaagtggtgaccagagttgcattttttaaagaaacaatccaaatgagttttgtacacaataaggttgagaattgcagcttaagaaatggtcacttgctgtcagtgtgggcacatctttgcaggatactgtagcagggagctgtgcccagccatgtgattacaaagggtggaaggcctaatactaactctgtctacttcataaagattcctcaaattgccgggcatgagccactgcacccggcccacaaaatgtgtgctatgngcacaataaatgacagcctgtgaaacaaagaagc

SEQ ID NO: 35432 - DNA, 378 bp, Homo sapiens
  misc_feature 377: n = A,T,C or G
gttacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatana

SEQ ID NO: 35433 - DNA, 171 bp, Homo sapiens
  misc_feature 11: n = A,T,C or G
aagtctaaacnggaagaagtcgaatccctgaatagaccaataacaaattctgaaattgaggcagtaattaatagcctagcaaccaaaaaagtccaggaccagacagactcacagccaaattctaccagaggtacaaagaggagctggtgtcattccttctgaaactattcc

SEQ ID NO: 35434 - DNA, 334 bp, Homo sapiens
agaggaaaagatagggaaaggatccatatacaagtgatggctaaaaccccaggaagggctgccgtcagtttggaggaagtggggaatgaacagtgagatggctggaatggcggggggagggcagtggtgtgatttctgttctgttttgttggggtaggacagacttgagcatctttatgggagtaagacttctaaaactactgtgtacagaaatagggattaatggctcagtctgggtcctaaagataggggagggattataatcaaaggcagaggcagaaatgcagggtttgccttggaaaggagggaggagatctgtgaagaggatgagaac

SEQ ID NO: 35435 - DNA, 210 bp, Homo sapiens
gggctgtgccaagtgtgcccagggctgcatctgcaaaggggggtcggacaagtgcagctgctgcgcctgatgctgggacagccccgctcccagatgtaaagaacgcgacttccacaaacctggattttttatgtacaaccctgaccctgaccgtttgctatattcctttttctatgaaataatgtgaatgataataaaacagctttgacc

SEQ ID NO: 35436 - DNA, 392 bp, Homo sapiens
aggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggcgtgaccccatatatgattttctttaaggatggtttaga

SEQ ID NO: 35437 - DNA, 464 bp, Homo sapiens
  misc_feature 5, 26: n = A,T,C or G
atttntatttacattatatgaaaatnattacattataaaaggaacccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatggga

SEQ ID NO: 35438 - DNA, 420 bp, Homo sapiens
gaccttggagaacgcaaaccatccgtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattg

SEQ ID NO: 35439 - DNA, 439 bp, Homo sapiens
taagagtccctgtgtcatcttccaaaatgtttaactaaaatttctggatctgtcttttttgccataaaattttgtttggatttcattaactctgaggtttaaaaagttataatttaggctgggaggggggctcacatctgtaatcccagcacttttggaggctgaggcgggcggatcatgaggtcaagagatcgagaccatcttggccaacatggtgaaaccctgtctctactaaaaatacaaaaattagctgggcatggtggtacatgcctctaatcccagctactcaggaggcagaggcaggagaatcgcttgaaccagggagtcggaggttgcagtgagctgagattgcgccactgcactccatcccggcaacagagcgagactccatctcaaaaaaaaaagttataatttaaaaaataagttatgatttatatga

SEQ ID NO: 35440 - DNA, 280 bp, Homo sapiens
  misc_feature 280: n = A,T,C or G
cgcggtggtttatgcctgtaatcccagcactctgggaggccaaggcgggcggatcacttgaggtcaggagttcgaaaccagcctggccaacacggcgaaaccccatctctactaaaaatacaaaaaaaattagccaggtgtagtggcaggcatctgcaatcccagctacctgggaggctgaggcaggagaattgcccgaacccaggaggcggaggttgcagtgagccaagatcatgccactgcactccagcctgggcgacagagtaagactctgtctcan

SEQ ID NO: 35441 - DNA, 238 bp, Homo sapiens
  misc_feature 14, 70: n = A,T,C or G
gggaaatgcaaatnaaaactacaatgagatgccaccttattcctgcaaaaatggccataatttaaaaatnaaaaaataatagatgttgttatagatatgatgaaaagggaacatctttacactgctggtgggaatgtaaactagtacaaccactatggaaaacagtactggagattccttaaagaactaaaatagaactaacatttgatccagcaacccactagtgggtatttaacct

SEQ ID NO: 35442 - DNA, 150 bp, Homo sapiens
  misc_feature 22: n = A,T,C or G
tgttctttgccgtctcattttntcttcttcctggttccacagaagctttgtttcttgggcaagcagaaaaattaaattgtacctattttgtatatgtgagatgtttaaataaattgtgaaaaaaatgaaataaagcatgtttggttttcc

SEQ ID NO: 35443 - DNA, 473 bp, Homo sapiens
attcttgccctttacaatacagcactgaagccggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatgggga

SEQ ID NO: 35444 - DNA, 347 bp, Homo sapiens
  misc_feature 5, 8, 19: n = A,T,C or G
aactnttnaggccttttcncacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagagactcagtggtgggagagatccctgcagaacccaccaaccaggaac

SEQ ID NO: 35445 - DNA, 103 bp, Homo sapiens
taacagtctgaggtgggaggattgcttaaacccaggagttcgaggctgctgtgagttgtgatctcaccactgttctcccaccagggcaacagagtgagactat

SEQ ID NO: 35446 - DNA, 446 bp, Homo sapiens
  misc_feature 388, 409: n = A,T,C or G
caaggactgagagagaaagaaggtcagaaaaacacagagatcaaaattcaagaggttcaaattggagagatcctataacaaagtacacatcagacaaagatgttccttctgaacgaaataactacagtagagttgcaaatgacagagaccaagaaatgcatatagatttggaaaataagcatggtgatcccaaaaagaagagaggagagagaagaaattctttttctgaaaatgagaagcatacacaccgaattaaagacagtgaaaatttcagaagaaaagatagatcaaagtcaaaggaaatgaatagaaagcactcaggctcaagaagtgatgaagatagatatcaaaatggtgccgagagacgatgggaaaaatctagcagatnctctgaacaatccagagaatnaaagaaaaatcaggaccggcgaagagaaaaggctcca

SEQ ID NO: 35447 - DNA, 347 bp, Homo sapiens
caattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatctctgttgatttgtttgtgccttttattaactgccattttctaaaatttttttcaataaaaggaaggaagat

SEQ ID NO: 35448 - DNA, 313 bp, Homo sapiens
gagatagagatgatgaacggggttaccgaagggttcgccctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagt

SEQ ID NO: 35449 - DNA, 180 bp, Homo sapiens
  misc_feature 136: n = A,T,C or G
attgcactagaatttgaatgatactgttgttggcatttctgtttctctttcaagtagttgtaaataatctctttttctcatataaacggaatgcataatgtcttactcttgagtcatttagtagcattgatatggnaccaagttgtatagcagagtaacaaaatcatgattggacaatga

SEQ ID NO: 35450 - DNA, 162 bp, Homo sapiens
  misc_feature 16, 112, 152: n = A,T,C or G
attgtggaaaactttnagtgaacagaaggatggtgtcctactgtggatgagggatgaacaaggggatggctttgatccaatggagcctgggaggtgtgcccagaaagcttgnctgtagcgggttttgtgagagtgaacactttccacttttngacaccttat

SEQ ID NO: 35451 - DNA, 255 bp, Homo sapiens
  misc_feature 160, 228: n = A,T,C or G
ataatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgncaccaagccaggccatatcattaaccccataaaagcagaagacgtgggctaccggacttcctcaaggncggacctgtctgtcatacagaggaatc

SEQ ID NO: 35452 - DNA, 187 bp, Homo sapiens
gtgagtggttctgagcaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttt

SEQ ID NO: 35453 - DNA, 209 bp, Homo sapiens
  misc_feature 6, 102, 108, 148, 158, 172, 193: n = A,T,C or G
ggatcnaaccaggatccagcctttagttggttaacagttagttgattagttggcactcattttgtcacatgattcaggatgactgggggaaaacaggatatnggggtntatctggaacttttggcacttctaagataatctacagggngccctacctntcgctcatacctgncctatccaagatcagaactgnagaccggccccatggg

SEQ ID NO: 35454 - DNA, 162 bp, Homo sapiens
gatgcatagaatgaaaatgttatttagtcttctcccaaattttcaaacataaatattaggctccatattaacctacacaaaccagccaaaaatcccattaggagatcttaaaaagaaagaaaatctctgcaaacatcattaactcaccccaaagctgcttcc

SEQ ID NO: 35455 - DNA, 369 bp, Homo sapiens
cagtatgaattacagaatgctgtgcatgttcgttagtaccaataccatgtgtatgtggtaggagttgtaaccagtttctggatctgtatggtactataaaatacttattttataattctgtaaccgtatggcagtgttatgccaaaaatgtataaagagcaatagtttttgttgcttactgctgtattttaaaatattgtttctaaaataatagagttagagttccttttgagtaattatttttaagaactattgccaaatatacatcctgtaaaactaataaaagccactccatcttagataacattttagcattgtgctagagtacattatggtgattttgcacgattaaaatatttttaaagaact

SEQ ID NO: 35456 - DNA, 388 bp, Homo sapiens
  misc_feature 344, 374, 377, 383: n = A,T,C or G
ggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggncagaacaggtaaacactgcctttcctcctnctnttattntatga

SEQ ID NO: 35457 - DNA, 172 bp, Homo sapiens
atgtgtgtgtgtatatatcctgtcccttccccctcattcctggtcccctgcctcaagtagggctaaaagaaacaaggtcatttcctatagaagaaagtatgtatgcctcctgaatatgtggagtttaactttttattttgacataataagtgactcacagaaaattaccaca

SEQ ID NO: 35458 - DNA, 163 bp, Homo sapiens; identical to SEQ ID NO: 34113
  misc_feature 163: n = A,T,C or G

SEQ ID NO: 35459 - DNA, 262 bp, Homo sapiens
atcctaggtaattcttatgcatgatacaggttgagaccagtgccatgtacagaagtgggaaaaatggcttatgaaactcagttgtatttagcacactgtgttagacataaaatttgaaaacccaacctggacaacacagtgagacccagtctctactaaaataaaataaataagtgaacattgaaaaccaatggatagtagaatgtattcagttcagtgagacatgaaacaatatttttgcttaattgaatcaaacatatga

SEQ ID NO: 35460 - DNA, 400 bp, Homo sapiens
  misc_feature 328, 381: n = A,T,C or G
gaactcggtggtggccctgcgcagaccgacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcctattttacttcttttagctgtttaactttgtaagatgcaaagaggttggatcaagtttaaatgactgngctgccccttgcacatcaaagaactactgacaacgaaggccgcgcctgccttncccatctggctatctatct

SEQ ID NO: 35461 - DNA, 248 bp, Homo sapiens
  misc_feature 239: n = A,T,C or G
taaatcagtcacggatagctttctcagcaatttcatataaatcctcattttgcttgaacagttgcataatgatccattctatggctgttacatatttatcccacctattcctgaaaatttaggtcatgccaattttgtttttgtttttgtttttactgtcatggaacgacaagcctgctgcatccttgttcatactcagagctttatgcactcatatgtgatcttgggagaaacgattnctagaggag

SEQ ID NO: 35462 - DNA, 159 bp, Homo sapiens
  misc_feature 32: n = A,T,C or G
agaagcaactaatgttagtataagtaacatgnaaacattctcctccgcataagcctgcgtcagattaagacactgaactgacaattaacagcccaatatctacaatcaacccacaagtcattattaccctcactgtcaacccaacacaggcatgctcat

SEQ ID NO: 35463 - DNA, 253 bp, Homo sapiens
  misc_feature 7, 31, 199, 209, 224, 244: n = A,T,C or G
gcaatcnggcaagaggaagaaataaagggtnttcaaataggaagaatggaagtcaaattgtctgtgtttgcagatgacatgattgtatatttatttagaatacccgatcgtctcagccccaaatctccttaagctgataagcagcttcagcaaagtctcaggatacaaaatcaatgtgcaaaaatcacaggcattcctntacaccaatnatagacaatcagatngccaaatcatgagagaactnccattcaca

SEQ ID NO: 35464 - DNA, 309 bp, Homo sapiens
  misc_feature 272, 292: n = A,T,C or G
ggcaagaacaagcgccttacgaaaggcggcaaaaagggagccaagcaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtnaaaactgcctgactaacttncatggcatggatcttac

SEQ ID NO: 35465 - DNA, 284 bp, Homo sapiens
  misc_feature 191, 193, 248, 273, 277: n = A,T,C or G
gtaacaaggcaacatccattgtgtaaaatgttcaggtataacaacaaagtaataatctctaataaatatattgtctaggctgagcgtggtggctcacgcctgtactcctaccactttgggaggccaaggcaggcggatcatttgaggtcagaagttcgataccagcctgaccaacatgatgaaaccccgtntntactaaaatacaaaaattaatcgggcatggtggcgggcacctgtgatctcagctnctcgggaggctgaggcaggagaatnactngaaccca

SEQ ID NO: 35466 - DNA, 118 bp, Homo sapiens
ctgcataatgaattaactagaaataactttgcaaggagagccaaagctaagacccccgaaaccagacgagctacctaagaacagctaaaagagcacacccgtctatgtagcaaaatag

SEQ ID NO: 35467 - DNA, 100 bp, Homo sapiens
cttcgggtcaaggcagaggcagcaaactaactggtgtgagtcaaatgccccctgagtgactgcccccagcccaggccagaagacctcccttcaggtgccg

SEQ ID NO: 35468 - DNA, 153 bp, Homo sapiens
  misc_feature 20, 24, 108: n = A,T,C or G
acttctggaacactcgctgnagcnttattgtttagccccaagcaagatttatctcctcctgccccgcatgtgtatggtgggcctctgtaaccttgaaatgtgcaatgngaccaattgttgactaccaaaagaaaaggtctggggttgtcaaat

SEQ ID NO: 35469 - DNA, 144 bp, Homo sapiens
  misc_feature 25, 107, 110, 124: n = A,T,C or G
cttattgttattaaaacctaacacntggtcatatgctatttactttatgtgtttctaatttttatttgcgtatttggcctaagcatatttatatctgcttctgagtnatngctgcattggtatntgtggggtacttcataaaag

SEQ ID NO: 35470 - DNA, 106 bp, Homo sapiens
  misc_feature 30, 31, 32, 103, 105: n = A,T,C or G
ggctctcacctgtaatcccaacactttggnnngcagagacaggaggatcacttgagcccaggagtttgagaccagcctgggcaacatagggagaccacatctntnc

SEQ ID NO: 35471 - DNA, 266 bp, Homo sapiens
  misc_feature 33, 248: n = A,T,C or G
ctgcacgcaaacaagtttcacaaaagaagcctncaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatntgattttctttaaggatg

SEQ ID NO: 35472 - DNA, 212 bp, Homo sapiens
  misc_feature 140: n = A,T,C or G
tctgtacgtggccatggccagacaccccagtcccttcaccaccacctgctccccacgccaccaccatttgggtggctgtttttaaaaagtaaagttcttagaggatcataggtctggacactccatccttgccaaacctntacccaaaagtggccttaagcaccggaatgccaattaactagagaccctccagcccccaaggggaggatttg

SEQ ID NO: 35473 - DNA, 167 bp, Homo sapiens
  misc_feature 24: n = A,T,C or G
ctctgatcgccgatcacctctganacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 35474 - DNA, 197 bp, Homo sapiens
  misc_feature 6, 31, 32, 192, 193, 196: n = A,T,C or G
gtttgngactagcgtggacaacatgatgaanncccatctctactaaaaatacaaaaattagctgggcgtggtggtgcatgcctgtaatcccagctacccaggaggctgaggcttgaacccaggaggcggaggttgcagtgagccaagatcatcccactgcattccagcctgggtgacagagtgagaccttgnnccng

SEQ ID NO: 35475 - DNA, 154 bp, Homo sapiens
agccttcccttatctaaggggcatggagctcagggaggctttattccatatgcacgggagaatcaggcagaatgaacccctacccatctttcttggcttttcagtcattttgtgctgttttctctggttcattaataaattgaaactgccctcc

SEQ ID NO: 35476 - DNA, 384 bp, Homo sapiens
aataaatggatctaccataatatgccacataatgcatataggggatgggagtgtgaatgtaaataatgaattttttgctttccttactcctgtgaaaaacattgaccataaacttttcctgacacttgaggtttatggtgaaacattctaactcacatgttctctggccaactcacagtgatgcattggctgttggcatcttcttgctgagaagcaaacattagcattttactctgtcttaacggaagaaatgtaagtcaaaatccttcatatcacctggatgccacgtgcagctggattggcctgtagaccactaaccagatttctgggctatctaagacgctgcattccctttgagaaatcaacatttggtagtttgtttta

SEQ ID NO: 35477 - DNA, 257 bp, Homo sapiens
  misc_feature 24, 241: n = A,T,C or G
tgtaattcatcttcagttcaacancatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctnaacaatgagtaaagga

SEQ ID NO: 35478 - DNA, 100 bp, Homo sapiens
  misc_feature 6, 17, 30, 40, 44, 59, 61, 75, 80, 88, 91, 99: n = A,T,C or G
aacacnaggtctcgctntgttccccaggcnggaatgcaanggcncaatcatagctcacngnaacttccaactccngagcnccagcagnccncccacctna

SEQ ID NO: 35479 - DNA, 120 bp, Homo sapiens
acaacactcatctgtcaaacaccaagcactctcagcctccccgccttcagctgtcagctttctggggctaacttctctgcctttgtggttggaggcctgaggcctcttggaactcttgct

SEQ ID NO: 35480 - DNA, 260 bp, Homo sapiens
  misc_feature 30, 55: n = A,T,C or G
cttgcttgttagtaagtggtaactatatanctgcgtctttctctttagcttagtnaaactttagtcaaatttatatctgaaggtggtaatatactcatctctaatttctttaagtacttttattattacatgaactcaagttaaatattatgtgttatgtttaaatgtattgattagatgtctgaagcccttttgggaagtaggaaggatgatacactaatccatgtggttgcccattgttttttgaaaatgacatactt

SEQ ID NO: 35481 - DNA, 202 bp, Homo sapiens
  misc_feature 156, 169: n = A,T,C or G
accagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagnagcaaaggagtgngcaggacttgtggccccggattgcatccaatgc

SEQ ID NO: 35482 - DNA, 219 bp, Homo sapiens
  misc_feature 20: n = A,T,C or G
cgcaataagacgcacacgtngtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacct

SEQ ID NO: 35483 - DNA, 100 bp, Homo sapiens
  misc_feature 25: n = A,T,C or G
taccaccgtcttggctcctgtggangcctgctgggaacgggacttctaaaaggaactgtgtctggaaggctgggggccaaggccgtttggtgctggctgt

SEQ ID NO: 35484 - DNA, 109 bp, Homo sapiens
cctgtgagttgagcattccccttttacagatcaataaactgaggctcagagagaggcagtaacagtgtcttgcccatctccgtgtcctgcctagggcttcccttttgtg

SEQ ID NO: 35485 - DNA, 124 bp, Homo sapiens
cgtaccactcttagcggtggatcactcggctcgtgcgtcgatgaagaacgcagctagctgcgagaattaatgtgaattgcaggacacattgatcatcgacacttcgaacgcacttgcggccccg

SEQ ID NO: 35486 - DNA, 105 bp, Homo sapiens
  misc_feature 7, 24, 31, 98: n = A,T,C or G
cgggctntttagtggcccggggtnatgattnacctggcacattggattcatctttttgcttacacttaaatcttttctagtattcgtttaagtcagtnacatatt

SEQ ID NO: 35487 - DNA, 247 bp, Homo sapiens
  misc_feature 6, 246: n = A,T,C or G
acaaanatgaaggtattcattcccttattcttcagtcaccaaacacttctttttaaaacatttttctttatgtctcatggattagaccctaggcattagtgaattaatgcaagagcatttatctctttgtaagtttccatttagctgtaatggaaaagaagtgtctaaactagatgcagctaatttgaaattcctgtctcctttttttcttctgattaaaaaaaaaaatgcatttaccagtactgnc

SEQ ID NO: 35488 - DNA, 144 bp, Homo sapiens
  misc_feature 6, 129: n = A,T,C or G
gaggcnttgaggcagccagcgcaggggcttctgctgagggggcaggcggagcttgaggaaaccgcagataagtttttttctctttgaaagatagagattaatacaactacttaaaaaatatagtcaatnggttactaagatatt

SEQ ID NO: 35489 - DNA, 253 bp, Homo sapiens
  misc_feature 5, 31, 219: n = A,T,C or G
atagnaaataagagtaatccttcagactaanatgaaaggaaactagagagtaactcaagtccacatgaagaaataaagagcctaagtaaaggcaactacacaggtaaatataaaacaacataagggtattgttttatatgcaactctttttttctccaacctgattttaaaaacaactgaataaagcaataattacaaatttgatgtgcacacatcgtntaaacataaaattaatatgacaacaccacaaggc

SEQ ID NO: 35490 - DNA, 195 bp, Homo sapiens
  misc_feature 166: n = A,T,C or G
tgctgcttgaagtgctaataatgtcaaagacacttaagaagatgaaataatattcaaatttcattttttcctttttccatttatctgtggaaaccaacagatattgctctatattttttgtattagtatggtttgagacaacatatggaaaatgttcacatttgtngattaagctggaattataatgagagcaat

SEQ ID NO: 35491 - DNA, 209 bp, Homo sapiens
ataagcaactatttcttataaagttaaacatatcatttacctaatgtgtcaggaggttcccagaatcatccctaggttccatggttcgctaggacaactcacaggactcagcatgatgtcgtactcatggctctatcacttactacaatgaaaagacacaaagcacagtcagcaaagggaaaaggtgaatggggcaaaatccaggggag

SEQ ID NO: 35492 - DNA, 295 bp, Homo sapiens
  misc_feature 32: n = A,T,C or G
aatgccccaactaaatactaccgtatggcccnccataattacccccatactccttacactattcctcatcacccaactaaaaatattaaacacaaactaccacctacctccctcaccaaagcccataaaaataaaaaattataacaaaccctgagaaccaaaatgaacgaaaatctgttcgcttcattcattgcccccacaatcctaggcctacccgccgcagtactgatcattctatttccccctctattgatccccacctccaaatatctcatcaacaaccgactaatcacca

SEQ ID NO: 35493 - DNA, 216 bp, Homo sapiens
  misc_feature 30: n = A,T,C or G
gggcacagagaaccggaagtttaaaatggntaatcaaagaataagagagctgaacatactgacatactgattctttgaagagaaacttggggttcactatatttaacattgggaggctgaggctggagaattgcttgagcctgggaggtggaggttgcagtgagccaagatcacaccactgcgctccagcctgggcgagagagtgagactctgtcc

SEQ ID NO: 35494 - DNA, 228 bp, Homo sapiens
  misc_feature 30: n = A,T,C or G
aatacaatacttactcacctgtattcagtnaacttaggataaattattgcttttgcaggcatgccaccttctttcctcaacctttcatcattggcatcaagccacattgccatcgtgggctgatccttaccatggaccttccgtttattggcaaagatcacaggtccaactcttcctccttctattctgcccatgtatgttatattacttgacttttagcttttctac

SEQ ID NO: 35495 - DNA, 236 bp, Homo sapiens
cctgtaagaatactgaccttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattac

SEQ ID NO: 35496 - DNA, 297 bp, Homo sapiens
gagcggaaatggtatcttctggatatctatacatcaatgcttgttccatggcatttcacatcccttcagctttgccataaaggcacatattagtttgaaggagtgtagtccttctcccccaaactttaaatggtgagggagataaggatagggatagctcacaggcaatcaatagaaatccacaaacttaggccaggcacagtggctcacacctgtaatcccaacactttggaaggctgaggtgggctgatcacgagatcgcgccactacactccagcctgggcaacagagcgagac

SEQ ID NO: 35497 - DNA, 182 bp, Homo sapiens
  misc_feature 32: n = A,T,C or G
agggttctggatattaaattaaaatggcattnttaaagattttcttcaaaaagcaatcctaaatgaaagtgtgtaaattataagaagctggcgatcttttgatatgctgtttcacaggattctgacactggagggcagctgtcttgtgcattacttgtgtttccagcaccaaagttgtggga

SEQ ID NO: 35498 - DNA, 164 bp, Homo sapiens
catccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtacattgaaaataaggttgatcat

SEQ ID NO: 35499 - DNA, 182 bp, Homo sapiens
  misc_feature 123, 145, 161: n = A,T,C or G
aacaagcatgatcttgttactgtgatattttaaatatccacagtactcactttttccaaatgatcctagtaattgcctagaaatatctttctcttacctgttatttatcaatttttcccagtntttttatacggaaaaaattgtnttgaaaacacttagtntgcaggtgataagaggaattt

SEQ ID NO: 35500 - DNA, 303 bp, Homo sapiens
tcggcctcccagggtgctgggattgcaggcgtgagccactgcgcccgacctttttcacttctcttaatgctctgtaaacattaatgtatttatatatgtatttagaattttaaaaaatcaattttattgagttataattaacatacagtaaaaatgctcccatcttgagtaattccatgccttttgacaagtgttctgtacccatgccacgaccaccacaatcgagagagaacatcttcatcactccagaagggctcctttgcagtgagtactccctaggagttccagcggccggtgacattg

SEQ ID NO: 35501 - DNA, 194 bp, Homo sapiens
  misc_feature 5, 29, 30: n = A,T,C or G
gcttnctaactccgctgccgccatggctnntgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtg

SEQ ID NO: 35502 - DNA, 235 bp, Homo sapiens
  misc_feature 7, 27, 33, 230: n = A,T,C or G
aaagaanatgaatagacaagccacagnaatganttaaaaaaacagaaattcccagcatttacaagggattaaagatgtgtatcagaatatataaagaacctctgaaggccaggtgtggtggtttacacctttaatcccaatgctctgggaggccaaggtgggaggatcatttaaagctaggagttcaagaccagcctggtaacatagtgaaacaagattctgtctttgcngagga

SEQ ID NO: 35503 - DNA, 287 bp, Homo sapiens
  misc_feature 59, 216, 245: n = A,T,C or G
aacattcagcccaacaagaaatctccaccagtttccccgagtggcgaagaaactgggantgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctntcccaatcgctttaagctctggttcactntggatcatcccccaaaagattgggcctacagcaagggctttg

SEQ ID NO: 35504 - DNA, 158 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctggctgagcggggctgg

SEQ ID NO: 35505 - DNA, 100 bp, Homo sapiens
  misc_feature 33, 36, 87: n = A,T,C or G
ctactaaaaatacaaaaattagcccggtgtggnggngcatgcctgtgatcccagctactcgagaggctgaggcacaagaatcgctgnaaacccaggagtt

SEQ ID NO: 35506 - DNA, 238 bp, Homo sapiens
  misc_feature 228: n = A,T,C or G
ctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttggaaggagggtaaaaagactaaaatgagggggaacagagttcactgtncaaatttgac

SEQ ID NO: 35507 - DNA, 277 bp, Homo sapiens
  misc_feature 3, 6, 162: n = A,T,C or G
gcngcnctactaacttgccctttctgccgttttggctttcagcatttcctgtgttacatctgcaaggaatacgtagaggatctggccaaaatccccaggagtttcttacaagaagcaaatgtcacccttatagtgattggacagtcatcctaccatcatatngagcctttttgcaagctgactggatattctcatgaaatctatgtcgatcctgagagagaaatttataaaagattgggaatgaaaagaggtgaagaaattgcttcctcaggacaga

SEQ ID NO: 35508 - DNA, 105 bp, Homo sapiens
  misc_feature 92, 96: n = A,T,C or G
attcgagggcggatcctctctggcgtggtgaccaaggatgaagatgcagaggaccattgtcatccgccgagactatctgcactacatccgcnagtncaaccgctt

SEQ ID NO: 35509 - DNA, 108 bp, Homo sapiens
  misc_feature 11, 12, 84, 94: n = A,T,C or G
ggcgcaatagnnatagtaccgcagggaaagagaaaaattataaccgagcataatatagcaaggactaacccctataccttctgnataatgaatnaactagaaataact

SEQ ID NO: 35510 - DNA, 364 bp, Homo sapiens
  misc_feature 8, 9, 12, 35, 51, 58, 66, 91, 98, 121, 145, 151, 194, 205: n = A,T,C or G
gctttctnngcncggcgctcggcaagttctcccangtagcaaagcctgttnagcttcnagcgcctngatcgtgaagcccaatggcgagaanccggacnagttcgagtctcggcatctcccnagctcttctggagctggagatganctcggncctcaaggctcagctcaggggagctgaatattgcggcagctantgaaatgtgangttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaact

SEQ ID NO: 35511 - DNA, 152 bp, Homo sapiens
aatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgaca

SEQ ID NO: 35512 - DNA, 444 bp, Homo sapiens
  misc_feature 1, 10: n = A,T,C or G
nagcccaaanaagaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccaga

SEQ ID NO: 35513 - DNA, 415 bp, Homo sapiens
actgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtatgtatgcttatttctat

SEQ ID NO: 35514 - DNA, 460 bp, Homo sapiens
  misc_feature 3, 7: n = A,T,C or G
agnagantagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagata

SEQ ID NO: 35515 - DNA, 100 bp, Homo sapiens
  misc_feature 6, 8, 17, 19, 27, 31, 34, 36, 40, 44, 46, 48, 49, 50, 90,95, 98: n = A,T,C or G
gactgntnacatttgcnantactgggntggnctnantgtngaanancnnnaacatcgtgttcactgagtctcaggaaggcccctcacttncgcangcntc

SEQ ID NO: 35516 - DNA, 304 bp, Homo sapiens
  misc_feature 14: n = A,T,C or G
tggtcactaaaagnagaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatg

SEQ ID NO: 35517 - DNA, 302 bp, Homo sapiens
ggaggccatggagcgctttgggtccaggaatggcaagaccagcaagaagatcaccattgctgactgtggacaactcgaataagtttgacttgtgttttatcttaaccaccagatcattccttctgtagctcaggagggcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttga

SEQ ID NO: 35518 - DNA, 330 bp, Homo sapiens
ggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcga

SEQ ID NO: 35519 - DNA, 473 bp, Homo sapiens
gcagaatggcagctgctgggcctagagtctagtgcaggtacttgtgaagggatcattcttactgaatatgtctgttctcttctatgtactttctgaccctccagggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcacccctctgacaggggggcagttgtgaggccacagagtgccttgacacaaagattacatttttcagacccccactcctctgctgctgtc

SEQ ID NO: 35520 - DNA, 353 bp, Homo sapiens
agcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaggagtctggtttggccagaggccccctccggcccacgtcaccctgagtacacccctctgattgctctgctgtcaagaagcacgtttccaccagctgtattcaacactacaatgcattttttaaactatatttgcatccaagacaataaagacaccttattttttttg

SEQ ID NO: 35521 - DNA, 167 bp, Homo sapiens
  misc_feature 3, 19: n = A,T,C or G
ganctcttagcggtggatnactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcaaaagaag

SEQ ID NO: 35522 - DNA, 207 bp, Homo sapiens
agctaagtaaatgttatagtaggtatattggattcagggcaccttttacctgaaaagcttacttgctctagggagcttaacaatcaagtagggaaagactgtgtttgcatactacactgttctcagagtgtgaaacacaaatctggaaatgattttgctagttttaaatgtcacactattgatctctagaattaatatttatctgat

SEQ ID NO: 35523 - DNA, 469 bp, Homo sapiens
  misc_feature 28: n = A,T,C or G
atctggtctacatttaagtctttaattnccttgagttgatttttgtatatggtgagagataggagtccagttacattattctgcatatgaatatccaattttcccagcaccacttattaaagaaggaattctttccccagtgtacgtacttggtatcattgttgattattaattggccgtaaacatgtggctttatttccgggttctctattatgttccactgatcttgtagaatgaaatttttatcttaatttcatgtagagcttgtctttatactgctttgtggtagctacaatgctctatcacaaagcaatacaaagatatagatgcacgtacttatttctgtcttatgttgacataactggcataagttctgtactatcaatcagcaaactttaaaaatgatttttaactgtgaaggtttaatgtcctgagtcacaagacatgataatatctattattatatcat

SEQ ID NO: 35524 - DNA, 463 bp, Homo sapiens
catggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaag

SEQ ID NO: 35525 - DNA, 411 bp, Homo sapiens
  misc_feature 14: n = A,T,C or G
caaattggttattncaaaaataaaaagatagtctcatgtgctcttatttttaagatgcgtattttaagcattaaaaccatatgttttgtaacagagtttgagtttttagactaataaaagttaccgagtaccattttattttggttttcatgatttggggctctgcggtgccaattatatttttttaatcctgtctgaaatgtctgatctgtgtcgtcataaaggaagcagtgcaggattggaaatcaggagaccccttttttgtcctttgggattcccctctctaaagagtttgggccagacctttatgatcttttccacttttaaaattctagtgttttttattttaaatctctgctagatcagaagcactgccttatggatgtacagccttagagctagattggaaga

SEQ ID NO: 35526 - DNA, 224 bp, Homo sapiens
gatcaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccc

SEQ ID NO: 35527 - DNA, 398 bp, Homo sapiens
  misc_feature 1: n = A,T,C or G
natattttatggtgataacaattatttcacaattttcttgatgaaaacaatatggtgaacattttaaactatttaaaacaagtttagtttattgaaactagtaagttcaataggctatacgcacagtacagataaatataaagcataacatgatacagaggataggaaaatgggacctaggaaaccaatttttgaatctcgcgatgcaaagaatattactgaacatttgagtaatacttcctgaagaaaaaggattcgtaatagtagagatactcagttggctgacgttttgttttattccaaataaatgactttttaaaatttaattttcatttaacagtatttgtggagctttctgctaggaatggtgttgagtgctagaattttgtataatgtat

SEQ ID NO: 35528 - DNA, 197 bp, Homo sapiens
  misc_feature 13, 21, 33: n = A,T,C or G
tcgcccgggaacncgccttcnggccggggaaangcaagcattgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgc

SEQ ID NO: 35529 - DNA, 168 bp, Homo sapiens
  misc_feature 7: n = A,T,C or G
caagaanaaacttcaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactg

SEQ ID NO: 35530 - DNA, 316 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttt

SEQ ID NO: 35531 - DNA, 276 bp, Homo sapiens
  misc_feature 10, 17, 220: n = A,T,C or G
aggccgggantcagggnacatttctgagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagntcttaaagactgaagacaggctattctctggagaaaaataaaatggaaattgtact

SEQ ID NO: 35532 - DNA, 474 bp, Homo sapiens
cagaggaggcaaataacattttaatttaggactttcggaaagatttcatagagagttggatctttcaggtcagaatatagaaaggggcatttgtagggagaaggggacgaaacagaagtacagaggcaaggaactgctgggagggaagtgtgtataagagtcatttcttttcaccagaaaatacagaatttctggtaggctttttctgaatattgaaaattgattataggtaggtgtggtgcctcaagcctataatcccagcactttgggaggctgaggtgtgtgaatcacttgagcccaggagtttgagaccagcctgggcaacacagtgcctgtctctacaaaaagttcaaaaaattagctgggcatgatggtgcatgcctatagtcccagctactcggaaggctgaggtggggaggatcacctgagctggggaggtcaaggctgttgtgagccattatcgtgccattgtac

SEQ ID NO: 35533 - DNA, 443 bp, Homo sapiens
  misc_feature 3, 10: n = A,T,C or G
agnactaggnaggatgagaggcacacatatattgaaggaactgaagggtctctctctatgtggatgtggaaactgatctccaaatgtttgcaagatggagggtacgtttaaaatatttcattctggttttcatattgatctctgtggctctccccttggtctttggtttttaaagcttaagaccattcccagaagctcttttccatggaataatctcctttctttgctggaatgctcctgttgggatgcaggaagggactctgagctcctgacagaatgaagaccacccctttttgctctccagacctaattttgacgtcccacgcccacccgctgaggagggttgcaatggcgagatctctgtcctgaattctggttctggcatgcagtggaaggccctctgattctgtttccttacctattttaatagtaacttatatttg

SEQ ID NO: 35534 - DNA, 233 bp, Homo sapiens
tatggccgggatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 35535 - DNA, 106 bp, Homo sapiens
ggggaatcagggttcgattccggaaagggagcctgagaaacggctaccacatccaaggaaggcagcaggcgcgcaaattacccactcccgacccggggaggtagtg

SEQ ID NO: 35536 - DNA, 134 bp, Homo sapiens
  misc_feature 9: n = A,T,C or G
aagaatggnacgcaccagtcctggctgcagctgggcagcaggggtaggggtagggagcctcccctccctgtatcaccccctccctacacacacacacacacacacacacacacacacacacacacacacacact

SEQ ID NO: 35537 - DNA, 466 bp, Homo sapiens
  misc_feature 11: n = A,T,C or G
gctgcgcagtngatccgagacatgttgacgtcgtccgagagtcttaaaatcctgctgtggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaagga

SEQ ID NO: 35538 - DNA, 474 bp, Homo sapiens
gctaaaatattttggagaactagaacagaataactggaatttccctaacaattttaataaaaagtatgctggtgttgattcagtattggacaataagtggaaagaataacattcggaaataaacattcagaagataagcccagtatatgtaagaatctaataagataaatatatttcaaattaatagggaaattatagttattctacatttacagaagattttggaagaaggtgctggctatttgttatggggaaaggatggattaattgctaccccatatttaagtatgttcttttttccttttttgtaatggcagtttgtcagtgtgaaataaaatgttcttttttaattaaaatctaaattaaaaattaaacatggagacaaaaggaaaataggctggcatttttacagtgtcagggtgggttagcaaagacatgatatcagaagcagaaaataaagtgatccgtttgact

SEQ ID NO: 35539 - DNA, 389 bp, Homo sapiens
  misc_feature 16, 24, 31: n = A,T,C or G
gaatgtcaaggcaaanatccaagnacaaggnaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcatcctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgaggggggggtg

SEQ ID NO: 35540 - DNA, 481 bp, Homo sapiens
  misc_feature 36: n = A,T,C or G
ggtaggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgccacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgct

SEQ ID NO: 35541 - DNA, 345 bp, Homo sapiens
  misc_feature 30: n = A,T,C or G
gatggagatgaaccaatggatttcaaaatnaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggt

SEQ ID NO: 35542 - DNA, 306 bp, Homo sapiens
gcattcttggtgttggaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatggagaaagataagctctcaacataaacagtgtactgcagatatttattacatatttattacaaagcc

SEQ ID NO: 35543 - DNA, 360 bp, Homo sapiens
atccagtaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttac

SEQ ID NO: 35544 - DNA, 150 bp, Homo sapiens
catttcattacctgattttcataacctcactctctgatgactatgtaacattactctcagtgcatgtttctcttactaccccctattgttggatgtctaaattgcgtctgatttttctctgttccataaaattgaaataaatatctttgt

SEQ ID NO: 35545 - DNA, 154 bp, Homo sapiens
  misc_feature 13: n = A,T,C or G
ctccaatacactncacactgtccatgttctttttattgccagggcccgtgttgaagtgtcaagagagcaatcatcaatgataatgtattgtgtgagacctttgcatcttgtaaattttctctttttttctaaaaataaataataataaaatcct

SEQ ID NO: 35546 - DNA, 272 bp, Homo sapiens
cgcagtggttcacgcctgtaatcccagcactttgggaggctgaggcgggcggatcacgaggtcaggagtttgagaccagcctcaccaatgtggtgaaaccctgtctctagtaaaaatacaaaaattagctgggcatggtggtgcatgcctgtaatcccagctactcggaaggctgaggcaggagaatcacttgaatccgggaggcagaggttgcagtgagccgagattgtgccacagcactccagcctgggcaatagagtgggactccatct

SEQ ID NO: 35547 - DNA, 412 bp, Homo sapiens
gtgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactgcacctggatttttccaaacaacttttatttcctcagagtcttccttaatcctatggaacaagaagctgccactgaatagggcccagtataggggcttgctttcctactccctccccccaatataaaaatatagactttt

SEQ ID NO: 35548 - DNA, 360 bp, Homo sapiens
ggagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaag

SEQ ID NO: 35549 - DNA, 382 bp, Homo sapiens
ggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgcta

SEQ ID NO: 35550 - DNA, 121 bp, Homo sapiens
  misc_feature 19: n = A,T,C or G
agagaaacagtacccaagnaaatgtgctcaattgcaatgggccacatacctagatctccagatgtcatttcccctctcttattttaagttatgttaagattactaaaacaataaaagctcc

SEQ ID NO: 35551 - DNA, 106 bp, Homo sapiens
caatgagttaacagctaagatgggggaaagttcctgtttatagaatgcacttaggaaaatcaacacctttcatgttgtgttttctgagaggatacatattttacag

SEQ ID NO: 35552 - DNA, 256 bp, Homo sapiens
gaccggttcctctctatcagcctccttctgaatctcttcattctgagagttctgcccataaagttagtcttgcatttatttcttcttcttgattcccaaggaatgattcagtagtacattctgtgaagaatgtaatacttggccaggcacagtggctcacgcctctaatcccagcacttcaagaggcggaggtgagaggattgcttgagcccaggagaccagcctgagcaataaagcaagcaagacctgtctctac

SEQ ID NO: 35553 - DNA, 229 bp, Homo sapiens
  misc_feature 40, 67, 70, 108, 111, 119, 130, 162: n = A,T,C or G
taaatgtaatacctcctcatcttttcttcttacacagggnctgagaacatttacattatagataagnagnacatgggggataacttctacttttaggaggactactcnctncggacagncctagactggncttctacactaagacaccatgaaggagtatgngctcctattattcctggctttgggctctgccaaacccttctttagcccttcacacatcgcactgaag

SEQ ID NO: 35554 - DNA, 232 bp, Homo sapiens
  misc_feature 3, 5, 6, 48, 140, 154, 163: n = A,T,C or G
gtntnngctatgtatcaaatttctatttatttgaaaacagatggaagntatttgtgaagataatgccatttactataaaataatataaagaaaagccagactctgaggactccagagacctgaaaggaggctatacttgncagcaatgaccggnacatagctngctacattcaccagctcatcaacagcaaggggaaaggcatagcaaggaaaccactgggatctggaaacc

SEQ ID NO: 35555 - DNA, 222 bp, Homo sapiens
atggccgggggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatc

SEQ ID NO: 35556 - DNA, 464 bp, Homo sapiens
  misc_feature 1: n = A,T,C or G
nattcccaaattatctccttgaatatacttacaaagggaaaaattataacttaaccatggagaaacccaagaggtaccaccttaaccaagtgaccaaggtcagcatcattagaacaagacataataatatcaccttctgcctgatacgatatttccgtagtgtatctgctaaaaatgcataacctcagtggaattataagaaattaaacaggcaggcatggtggttcacgcctgtaatcctggcaggtgtgaggctaaagcaggagggttgcttaagcccagcagtctagaccaacctgggtaccatagcaagatcccatctttacaaaaactttaaaaattagccaggcatggtggcgcacacctgtagtcccagccactcagaaggctgagggaggaggatcacttgagcccagaagtttgaggctgcagtgatctgtgctcgcaccactacgctctaccct

SEQ ID NO: 35557 - DNA, 418 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaga

SEQ ID NO: 35558 - DNA, 442 bp, Homo sapiens
ggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatat

SEQ ID NO: 35559 - DNA, 411 bp, Homo sapiens
  misc_feature 251: n = A,T,C or G
agtcaccgacgagtaccgaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgnatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacact

SEQ ID NO: 35560 - DNA, 439 bp, Homo sapiens
  misc_feature 5, 10, 26, 33, 37, 46: n = A,T,C or G
cctcnggttnttttggccggggtagnaaaaaanaaangcacatagnaaaaagcataaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacactgtgactggtctggttatttac

SEQ ID NO: 35561 - DNA, 371 bp, Homo sapiens
gagggaggtcagagcacgaggtatcacaaaactgcctattagaccctgggcaacatggtgaaaccctgtctctacaaaaatacagaaaaacgggcctggtgttgtggtgcatacctgtggtcccagctacttgggaggctgaggtgggaggattacttgggaccaggaggtcgaggctgcagtgagccatgatcacaccatacactgcagcctgagtgacagagagagaccctgtctcaatagaaaaacaagaaaaactacctattgtttactatgcttttcaccttggtgacaaaataacctttacaccaaacccccgtgacacacaatttgtctatataacaaacctgcatgtgtacccctgaacctga

SEQ ID NO: 35562 - DNA, 294 bp, Homo sapiens
  misc_feature 1: n = A,T,C or G
naatgttactagggcctggactgatatgctgatggaagtgagaatgaagaataaggtgggatgaaagagattttgacaagagttttttaatgaacctgaaacgggaaagggcgagattaactaagcctgtttgccatggacagcaatggggttgctagaagattagctgtgcggaaaaattatgcatttacctttgggcataataaaatgcaattgactctccatattcatgggttctgcatccactgattcaaacaactgtggaacaaaattgtcagaaaaaacaatacagtg

SEQ ID NO: 35563 - DNA, 458 bp, Homo sapiens
ggtccgataactgaagaatgttattgtcacgaaaaccaaagaaagactgagcaactgttttccgtctaaggagaccaaaggaatgttatggctaaatgcaaaaatggtcctggactggatcatacccttgggaaatgttatacagaacattattggggcaatgacagaatcgcagtgttatttggaattattatattggaatacaatgttaaatttcctgaatataactgtgctgggattatgtatgaaaatatttttcttagaaaatacacactgaagtattaaggaagtaaaggagcatattgtatgcaaccttttctgcaatggtttaggaaaaaaatgttcaaagagaggaagagaacaaatgtgacaaaatgttgaaaatcggtaaacctgtaggccagctgcagtggctcacgcctgtagtcccagcactttgagaggctgaggtgggcaga

SEQ ID NO: 35564 - DNA, 342 bp, Homo sapiens
  misc_feature 3, 7: n = A,T,C or G
ggncttnggccgggaagtcagtgatttttatatagcagcctggttagaagtgctcactctgaaatcaggttatctgagtttaggtccaggttcacccacttagggcatatggcctcagtggtcttactggtcttactaactggttttactcctatgtctttagcttacattaaggataaaattatttccccaataagtgggttgaaagtaacttgaacataccaagtgcttactacacctttgttattattttcaaattattattcatgtatttttgaacaaagttaagggacttctagccatgaattttgtactgttacatattaaaataaatattttatg

SEQ ID NO: 35565 - DNA, 340 bp, Homo sapiens
  misc_feature 9, 13, 127: n = A,T,C or G
cactccggncttnggccggggacgaagtaaatttggtcaagtctactcttccgttcattcaattattttaagcatttgaattatttattgtatatcctaaatatatttctcctttggtagtgactangatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttg

SEQ ID NO: 35566 - DNA, 441 bp, Homo sapiens
ggtttttcagctcacttcagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacat

SEQ ID NO: 35567 - DNA, 224 bp, Homo sapiens
  misc_feature 16: n = A,T,C or G
gttaatggaaaacagnattcttcgccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttgttggtccaacactaagtaaggaggaaaaagagtt

SEQ ID NO: 35568 - DNA, 137 bp, Homo sapiens
aatatgacattatgataataaactctcctggaaaaaggcagacattcagattagattagattagtaataacagcaactgtatgtgttataagagccacatcggaaacgtaatgatacagctttaaaacaagactggg

SEQ ID NO: 35569 - DNA, 399 bp, Homo sapiens
  misc_feature 3, 16, 33, 35, 46, 64: n = A,T,C or G
ccngggaattcggcanttatggcccggggtccncnaataaaagaanttttgccctgcccttttnagaatcttcttttgaagcctttctgttgatgttaacctgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccgaacactagctctgtattaatccccatcattactggtaaagcctcatttgaatgtgtgaattcaatacaggctatgtaaaatttttacctaatgtcattattttgaaaaaataaatttaaaaatacattc

SEQ ID NO: 35570 - DNA, 136 bp, Homo sapiens
  misc_feature 136: n = A,T,C or G
gtttgtgatttgttcctcatactgcagtgagtaaaaaagaaacaagaaaacaacaacataaatattaaagtacgtttcaatgttgggtgaattttgtttttagatgccaataaaacttatttgtttgataacagtn

SEQ ID NO: 35571 - DNA, 437 bp, Homo sapiens
  misc_feature 26: n = A,T,C or G
aatgcatgcggggcttaatacctagnatgatgggttgataggtgcagcaaactaccatggcacacatttacctaagtaagaaacctgcacgtcctgcacatgtatcccagaacttaaaataaaataaaatttaaaactttacctgactaaacaatgtacatttgtaggtgatttgctaggaatttcctactaaggagggacattagaagacctggtacagctgatgaaatactgaaaatcttcatactatgtagaaagcttagattcattcccttgcaggtgacagttgaagttttattattcttacttgttaatgtttcacgtctttatacctattttcccaactagactttaaatccttttagagtgagaaataaaccttgaactcctttagcaccctcatttcaaaaatgaagaactgcagccaagagaaagga

SEQ ID NO: 35572 - DNA, 291 bp, Homo sapiens
  misc_feature 14, 288: n = A,T,C or G
tgccccctccggancgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtnaga

SEQ ID NO: 35573 - DNA, 189 bp, Homo sapiens
  misc_feature 58, 98, 145, 160, 169: n = A,T,C or G
agtttaaaaatatttactaccatattgatgctcatttttaccacaaaacagattgttntgaaggaattataaagttagcacattttaaatattaccgntctgggttcactgtatataattaggttgatataagtcgtgatagatnattagcatgttgctncaaaaaatncctgagactggatgggcaca

SEQ ID NO: 35574 - DNA, 175 bp, Homo sapiens
atcgccaactggcagaagaagatcggggacatccttaggctggtggccggccgtatcaagaacaccttctgattgagcggttgccatggccggtctccgtggggcagggttgggccgcatgtggaagggctctgagctgtgtcctccttcattaaaagtttttatgtctcgtgcc

SEQ ID NO: 35575 - DNA, 372 bp, Homo sapiens
  misc_feature 4, 7, 371: n = A,T,C or G
gagnaanaaatccaacctctttatattaaaaatgaatacaataagaaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttggggaatttgagna

SEQ ID NO: 35576 - DNA, 500 bp, Homo sapiens
  misc_feature 8, 9, 27, 38: n = A,T,C or G
aggcaatnnattggccgggatattgcnatggtaagccngtagatggacctgactactttgcgcaatgggacattagttgcattccgaggtcattatttctggatgctaagtccattcagcccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctt

SEQ ID NO: 35577 - DNA, 441 bp, Homo sapiens
  misc_feature 2, 10: n = A,T,C or G
anggagggancttgggtttctgccctagtccctgttcatcttgacgggggtaagatcttgccaaaacacaaggagacagatgactgcaatgcaagttgtggggtaccctccattgctgagaaactcctgctagaccgcagccaaggggttttatgttctgcgactcttttctgagggagaataaggcagaaagtccatatctcagaacctgagaggtgatgagaagctgtcttgggacacctctgaggaagatggggaggccagtgaagagtgggaggggcctcccattcttcggtgttccaggagtatcacagggcaatcagtcttcaaggctcagggaaggctgagtccaagcctttgtttatatggaaggtcttaacggtgctatggcaaagtaacgcagcctggtagaagaaataaagataagacactccaagtcag

SEQ ID NO: 35578 - DNA, 328 bp, Homo sapiens
  misc_feature 2, 8, 31, 33, 34, 36, 44, 52, 76, 102, 114, 163: n = A,T,C or G
cngggggngggaacgcccctgaacataaccnanngntggggtcnggtggtcnaactgggccagtactcccctgganctttggacctttactacctactagtnttctgtaaaaantgcctacccccttgggggggaaaacctaggaaaaagtgtaccaagggantcctctcagtacctatttcttttttaaaaatttttatttttgtgggtacacagtaggtgtgtatatttatttcttagagcttcatgtgaatccatatctcaataaaaatttcaattaaaaaaagggagaggagaaaaagggaaaactcctttttacagaagaatg

SEQ ID NO: 35579 - DNA, 178 bp, Homo sapiens
ccattttcctttggttttccaccaaaattgaaatgaatttaaagggaaatttattgccattcattaaaaggaaaccctaagttgaagggtatatgaatggagttggtatttggtcttttgcacacacatataggtatattcctgaatacaagccttattcacattttgcttcctaatc

SEQ ID NO: 35580 - DNA, 491 bp, Homo sapiens
  misc_feature 9, 10, 55: n = A,T,C or G
aattcggcnnttatggcccggggatagtctgggactttcaaatcttcgaagagcnaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagct

SEQ ID NO: 35581 - DNA, 335 bp, Homo sapiens
atggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttc

SEQ ID NO: 35582 - DNA, 377 bp, Homo sapiens
  misc_feature 9, 28: n = A,T,C or G
tccggccantttatggcccgggaaaganctacctgatttcatcaagttcgacacctggtaaccctgtgtatggtgactggaggtgctaaccctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtggaatgggtccctgggtgacatgtcagatctttgtacgtaattaaaaatattgtggcccg

SEQ ID NO: 35583 - DNA, 449 bp, Homo sapiens
  misc_feature 11: n = A,T,C or G
tgaaaaaagcnttggataagtcacctatttacttcatgataaaaacccctcaaaaaactgggtattagaaggaaccaaacttcaacacaataaaagccccatatgacagaccctatggctagtatcatacctgattggggaaaaactgaaaggctttccttgaagatcaagaacatgataccggatgccccacttttaccagtgttattcaacacagtactggaagtcctagtcagacaatcagataagaaaaagaaataatgttcatccacatgggaaagggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaattc

SEQ ID NO: 35584 - DNA, 434 bp, Homo sapiens
  misc_feature 6, 8, 37, 49, 236, 244, 306: n = A,T,C or G
agggananggttggtgggtgctagtttctctaagccnttccagtgccantccctcgtcgctgcagcgacacaccgcctctcgccgccgccatgactgagcagatgacccttcgtggcaccctcaagggccacaacggctgggtaacccagatcgctactacccccgcagttcccggacatgatcctctccgcctctcgagataagaccatcatcatgtggaaactgaccagggggnattgagancaactatggaattccacagcgtgctctgcggggtcactcccactttgttagtgaatggtggntatctcctcagatggccagtttgccctctcaggctcctgggatggaaccctgcgcctctgggatctcacaacgggcaccaccacgaggcgatttgtgggccataccaaggatgtgctgaagtgtggcc

SEQ ID NO: 35585 - DNA, 109 bp, Homo sapiens
  misc_feature 10: n = A,T,C or G
cagcaaagtngaggccatgcgctggttccagcagaagtatgatgggatcatccttcctggcaaataaattcccgtttctatccaaaagagcaataaaaagttttcagtg

SEQ ID NO: 35586 - DNA, 302 bp, Homo sapiens
  misc_feature 6, 8, 11, 19, 20, 21, 22, 28, 30, 33, 38, 42, 52, 53, 55,56, 61, 73, 132, 133: n = A,T,C or G
tacctntntantccccccnnnngggaanantcnaaccnttcnttgggaaganncnntttcnagccttttgtantgcctctttctttgggtccccacctcaaaatgggggaaagttcctggctccgagggccnngaaaatagaaaacaggaagtcaaccagaacctgattttccctaactgcccaaatgccaaatcacccacacctcccgttatggatgagaattagagtaaaatgtaaacttctttttaaaaagaagttcacatgctaactgtgtacagaaaacatcctactccagggaaga

SEQ ID NO: 35587 - DNA, 302 bp, Homo sapiens
  misc_feature 5, 17, 28, 255: n = A,T,C or G
tgggngggggtttggantttgatagccnattagttcctgtgcctggttgcaaagaattgatatttagatggtttttaatacctcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttncttcataacccatttggaattattcctaataaaatgataaaatacgc

SEQ ID NO: 35588 - DNA, 223 bp, Homo sapiens
  misc_feature 4, 15, 67: n = A,T,C or G
gaanaaatattagangtgatttaatagtgttaatcaatttaaacccattttagtcctttttttttcnaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagc

SEQ ID NO: 35589 - DNA, 395 bp, Homo sapiens
  misc_feature 8, 9, 34, 40, 57, 58: n = A,T,C or G
ctcggccnnttaatgggcccgggctttccgggtntgtgcnataacctctcccagccnngtggtcctttccacagccctttctgtcccttaaaacaccctgcaactgggggagaaatgggaccccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggccgtggtgcccatgacatcaccgtcactctgcctaaaagcactctagagctacttgttcacgtggagagg

SEQ ID NO: 35590 - DNA, 337 bp, Homo sapiens
gggcgcggtggcgcgtgcctgtagtcccagagtgctggaattatatgcgtgagtcaccacgcttggcacaaaaacaatctttttgaaaaaactggggtaaaattcacatgacaaaatttgccatcttaatcatttttaagtgtatagtttagtagcactaagtatattcacattgttgtgtaacagagatccaaaacttcctcattttgcaaatctgaaactctgtacttattaaacagcttccacagtccctggtaatcaatcaccattctaactttgtttctgtcaatttgtctatttttgatacctcatataagttggagtcaaatagtatttg

SEQ ID NO: 35591 - DNA, 426 bp, Homo sapiens
  misc_feature 7, 22: n = A,T,C or G
tcggcanttatggcccggggcnagtaaggtagtttgggctccttaattcaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtac

SEQ ID NO: 35592 - DNA, 304 bp, Homo sapiens
  misc_feature 8, 19, 28, 29, 30, 36, 41, 86, 87: n = A,T,C or G
aggggaanactaggccaantaaggccannngagggntgaancttcttgtgggccaccaccctcctgctcctgaacctccctgggannggtgctattcagttctgtccctggccctttcagttttataagttggtttccagcccccagtgtcctgacttctgtctgccacatgagggagggaggccctgcctgtgtgggagggtggttactgtgggtggaatagtggaggccttcaactgattagacaaggcccgcccacatcttggagggcatctgccttactgattaaaatgtcaatgtaatc

SEQ ID NO: 35593 - DNA, 151 bp, Homo sapiens
  misc_feature 2, 3: n = A,T,C or G
annccgggtgtggtggccgtgtgtctgtagtcccagccttctagggagactgaggcatgagaatcgcttgaacccggggaggcagaggttgcagtgagctgagatcatgcccactgcactccagccctgggcaacagagtgagaccctgcc

SEQ ID NO: 35594 - DNA, 285 bp, Homo sapiens
  misc_feature 2: n = A,T,C or G
anttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcat

SEQ ID NO: 35595 - DNA, 354 bp, Homo sapiens
  misc_feature 6, 13: n = A,T,C or G
tggccngggtgangtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggga

SEQ ID NO: 35596 - DNA, 189 bp, Homo sapiens
  misc_feature 2, 24, 25, 27, 28, 29, 30, 37, 41, 79: n = A,T,C or G
tnccccctgggaacactccggccnncnnnnggcccgnggtntgtgggttttttgtttttgttttgcttctgagaaagcntttgccctttcttcctctcccaaccataaccaatcgtggtaaccagaatgcgactgctgatttacccgatgtatttaatgtaagtaaaaaaaggaaaaaaagaaaagggc

SEQ ID NO: 35597 - DNA, 472 bp, Homo sapiens
aagatttacagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgatgctgaaagaatcaggcaaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatcta

SEQ ID NO: 35598 - DNA, 260 bp, Homo sapiens
  misc_feature 3, 12, 24: n = A,T,C or G
aanttaagggcnagattcttgccnagagtaattaatgtgcgtattgagcacattaagcacctctaagagcccgagatagcttcctgaaacgtgtgaaggaaaatgatcagaaaaagaaagaagccaaagagaaaggtaccctgggttcaactaaagcgccagcctgctccacccagagaagcacactttgtgagaaccaatgggaaggagcctgagctgctggaacctattccctatgaattcatggcataataggtgtt

SEQ ID NO: 35599 - DNA, 174 bp, Homo sapiens
  misc_feature 21, 36, 80, 123, 125, 149: n = A,T,C or G
gcaagtaaggtagtttgggcnccttaattccaaacntcccatgagtatatcaagatgaataaggaccaagggacctctgngactcatatgaagggctggctgaatcctgaagtagcagtaggngngacctggtctacaatttatgcacntgcactgacagccttgctgtgccac

SEQ ID NO: 35600 - DNA, 148 bp, Homo sapiens
aagctgatggactcaatttgagccttaaacttgtagttatcctattatattgtaaactaatacattgtctagcattgatttggttcctgtgcatatgtattttcactatgtgctcccctccccagatcttaattaaaccagattttgc

SEQ ID NO: 35601 - DNA, 312 bp, Homo sapiens
  misc_feature 5, 8: n = A,T,C or G
gtaanatntatttcttatgtataaaggaagtaaattcagaaacattctaaaattggctttgaaacccgtttctagccagttgattaatgtggctccagaaacaatttgctaggaggtagtgttaagatagtaaaaggagcactggactaggagtgagaagacctgacttgtagcccaaagtctcccttctgaattagctgggagaccttctacaaatcacttagactcattcagccttgacacattattcataacactcaaaacacattaggcattactctacgatacttgtttattttctctgaggtccct

SEQ ID NO: 35602 - DNA, 386 bp, Homo sapiens
  misc_feature 10, 13, 30, 43, 46, 49, 70, 83, 104: n = A,T,C or G
taaagggganccnaaatttgggtaaacccnaagggttttttgnccnaantagccattgccttttagcccnaataaaattttanttaaattcccccctgaagaancccctgaatttgggttgtcaggaaatcccaaataacagtgagaagagagaagtcttatattgttcccttttatttttggcctattttatgtatcccattcacaagtttctgttttagctaagaactcaggattcctagctaagtcacatgatttaaagaaatattaatattctaagatatacaagatttgtaattttgctaactagggtattacgtcctaaggagcatatcttagtactcatggttaatacattattgttgtctaggattttctgtaggcca

SEQ ID NO: 35603 - DNA, 308 bp, Homo sapiens
  misc_feature 3, 11, 25, 43, 50, 54, 95, 97: n = A,T,C or G
ccntcttaaantcccccttgtaaantttaacttgttagtcccnaaagagngaanagcctctttggacacttaggaaaaaaacccttgtagaaganantaaaaaatttaacacccatagtaggccctaaaagcagcccaccaattaagaaagcgttcaagcctcaacacccactaccctaaaaaatcccaaacatataacctgaactcctcacaccccaattggacccaatctatcacccctatagaagaactaatgttagtataagtaacatgaaaacattctcctccgcataagccctgcgtcagat

SEQ ID NO: 35604 - DNA, 362 bp, Homo sapiens
  misc_feature 36: n = A,T,C or G
gggcagaggacgaataagcacctgcttcccgcaggnattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttacct

SEQ ID NO: 35605 - DNA, 229 bp, Homo sapiens
  misc_feature 11, 12, 30, 44, 60, 63, 65: n = A,T,C or G
taaaaaatacnnttactactagttttctantagtgtgtgtgtantgtgtgtgtgtattantanantaaccttttgtgttacatgcctctttgaaggaaagaaaggatgatcacttttaatgattggttattagcagtattacagtaatagcaatgctggattaaaaacttgcaattgaagaagagaagctctgattaactcaggacaacatgtttattcatttatctct

SEQ ID NO: 35606 - DNA, 352 bp, Homo sapiens
  misc_feature 4, 5, 328: n = A,T,C or G
gganncccccggcggggccgtttggtttcggtttggccctgactgggattagtgttgacgatcgaaatgggagtccccaagttttacagatggatctcagagcggtatccctgtctcagcgaagtggtgaaagagcatcagattcctgaatttgacaacttgtacctggatatgaatggaattatacatcagtgctcccatcctaatgatgatgatgttcactttagaatttcagatgataaaatctttactgatatttttcactacctggaggtgttgtttcgcattattaaacccaggaaagtgttctttatggctgtagatgggngtggttcctcgagcaaaaatgaac

SEQ ID NO: 35607 - DNA, 109 bp, Homo sapiens
  misc_feature 44: n = A,T,C or G
tatggactcagacagttcccccagcagcagctccacctactgtnaccaaatgatgaggcgccggaatatgacacaggggcggtgcaaaccattgaacacctttgtgcac

SEQ ID NO: 35608 - DNA, 119 bp, Homo sapiens
  misc_feature 6, 15: n = A,T,C or G
tagaantcttagttnaacctttaaatttgcccacagaacccctctaaatccccttgtaaatttaactgttagtccaaagaggaacagctctttggacacctaggaaaaaacccttgtag

SEQ ID NO: 35609 - DNA, 222 bp, Homo sapiens
  misc_feature 11, 12: n = A,T,C or G
accccgggaanntcggccatttatggcccggggggaagcagggtgagccgcgcctcatctttcctgctgtaggagatggtcttcaggagtgtgagagttctaggtacagctgcacgtatttgctaggtggcacattttggtacctaaaacattttccctaagaagtagcaaaccacccgtcgaacaccccctccctccctcccacaacttcaaaagaggagc

SEQ ID NO: 35610 - DNA, 459 bp, Homo sapiens
  misc_feature 1, 4, 25, 26, 27, 29, 31, 43, 46, 56, 69, 73, 78, 82, 83,89, 133, 145: n = A,T,C or G
nttncccccggggaatctccggccnnntntnggcccgggggcntcnttccggggancgtttgtcctgcnggcncttcngaannggtccnagccgtttgaccttacccgaccgtaggctttccctacaattacnagccctctaacnaaacctaggctgtcccgaaccccctggtaatagaattgtttaccctttatacccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaac

SEQ ID NO: 35611 - DNA, 395 bp, Homo sapiens
  misc_feature 8, 18, 27, 28, 31, 41: n = A,T,C or G
taactggngccccggganaccggccanntanggcccggggnctgaaatctatagccccttactcaatctatagccccttattcaaattttgccacttgtttgactaatgtcctcatagtaaaatagaacaaaaatggttttttttccggtctaggatccagtcaaggatgatgcattgcctttagttgtcttgtctttaatctcctttagctgagaacagttcttcagttattcttgtctttcaggacattgacattttgggagaacaggccattcattttgtagaatgttccttagtttgggtctgtctgatgttttctgttagattcatattatgaatttttggcaaaaataccacaaacatgatgtcatatcctactcagtggtgatttaac

SEQ ID NO: 35612 - DNA, 236 bp, Homo sapiens
  misc_feature 6, 22, 40, 68, 85: n = A,T,C or G
aatgcnaaggaagcctaagaanccttgataaaaggttacnaggaaacctacctaacctagaataaccnagtttagagaagaaccntaaatgatctgatggagcctgaaaaaccccagcatgagaaacctttgtgaaacataccccaagtatcaatggcccaaatcaagccagaagaaaggatatcagagattgaagatcaaccttaattaaataaagccatgaagaccaagattag

SEQ ID NO: 35613 - DNA, 176 bp, Homo sapiens
  misc_feature 11, 21, 29, 32, 73, 78, 88, 94, 97, 104, 109, 117, 146: n = A,T,C or G
tcggcctttantggcccgggntgagaaangantttcggcccttgccgaacaaagctggaatgatgcataatantacanctggtctggnaatctnttncatcatngttgngtctaatntacctctcattagaagggctaacaaattntaagtgccacaggttttaaggattctgcag

SEQ ID NO: 35614 - DNA, 271 bp, Homo sapiens
  misc_feature 1: n = A,T,C or G
ngggccaagtttttaaatttttttgtagagaagaggtctccctatgttgcccttgctggtcttgaactcctgtgttagtctgtcttctacacttctgcttccgatcatacatattttctggacttttattattgttttctgaggcaatcgtacttttcaggtgtctcgatatcctggctggttgctcatattctctgaggatatcggcttctcatcttctggcaacatataggtgggggaagtagcattgggaggggggggtcatctctac

SEQ ID NO: 35615 - DNA, 435 bp, Homo sapiens
  misc_feature 2, 20, 112, 146, 165, 271, 343: n = A,T,C or G
tnggggtgtggctgccaagnaacctgctggaggcataagatggtacaaatccaagtttgctgacctctctgaggctgccaaccggaacaatgacgccctgcgccaggcaaancaggagtccactgagtaccggagacaggtgcagnccctcacctgtgaagtggntgcccttaaaggaaccaatgagtccctggaacgccagatgcgtgaaatggaagagaactttgccgttgaagctgctaactaccaagacactattggccgcctgcangatgagattcagaatatgaaggaggaaatggctcgtcaccttcgtgaataccaagacctgctcaatgttaanatggcccttgacattgagattgccacctacaggaagctgctggaaggcgaggagagcaggatttctctgcctcttccaaacttttcctccct

SEQ ID NO: 35616 - DNA, 422 bp, Homo sapiens
  misc_feature 8, 11, 27: n = A,T,C or G
gcttttcntcnttccgtaaatggggancaataagagtacccttcgtaatagggcagttgtgaggagtaagtaagatgttacaggatgagtaccttaacagacactgagtagtaaatgttagctcttattacaggctacaggaaagaacttttaggaattagttgcagcaattcatggcaactagaactatgtcccattgagctgtcagaagtgtcctgagggatcacaagatcacagagttttattttattctttctgaaaagaaaatctaagggggagtttacccagtctgtatgggagccatgcagatgaattcagtttggctctttaaaagaactatttttaaaaatagaagtaggactgctgagaaaaaaatagtactttaaagtatacatgggttggccaggcgcggtggctaacgc

SEQ ID NO: 35617 - DNA, 315 bp, Homo sapiens
  misc_feature 16, 44: n = A,T,C or G
ggccacacccctgatnaggtacgactgctgtggacagacccacnaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtga

SEQ ID NO: 35618 - DNA, 443 bp, Homo sapiens
  misc_feature 1, 2: n = A,T,C or G
nntgggcccgggcagccgcattccctgccaggggctttctccctccctctgtcttttggagaaaccagggctcttctcaggggcctctagggacctgcccaggctgtttcagccaggaaggcccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatggggatgggtcggatctcacaggctgagaactcgttcacctccaagcatttcatgaaaaagctgcttcttattaatcatacaaactctcaccatgatgtgaaagaagtttcacaaatccttcaaaataaaaagtaatgacttagaaactg

SEQ ID NO: 35619 - DNA, 317 bp, Homo sapiens
  misc_feature 1, 3, 23, 24, 25, 27, 29, 40, 41, 46, 50, 83, 313: n = A,T,C or G
ntncccccggggacactcggccnnntntnggcccgggganntttantgcnagttgtaccaattttatttttttctgcaagaanaaagtgtaatgtattgaaaataaacccaaagtcaccttgtttgaaaaataaatctttattttgaaacctttataaaaagccaatgccagtacccccatagacctggtgttaaatgttgtctacagtgcaaaatccatgttctaacatatgtaataattgccaggagtacagtgctcttgttgatcttgtattcagtcaggttaaaacaacggacaataaaagaatgaacnccat

SEQ ID NO: 35620 - DNA, 123 bp, Homo sapiens
  misc_feature 3, 8: n = A,T,C or G
gcnagganattccccctctgttcctctgttcctctcttctcctgccccctagcaacccactggtgttttctgtccctcttgttcattgacatttatttttaaaataaaatattttaaaatcgg

SEQ ID NO: 35621 - DNA, 370 bp, Homo sapiens
  misc_feature 20: n = A,T,C or G
agggggcctgccagaaaccnaaatcaagccacatcccttgcctaaatttcaaaaacctacccagttctttatttgggtgaaaacatgaatcccagatggcatggttgctctattggactacccgtgaggatggtgtgacccccatatatgattttctttaaggatggtttagaaatggaaaaatgttaacaaatgtggcaattattttggatctatcacctgtcatcataactggcttctgcttgtcatccacacaacaccaggacttaagacaaatgggacctgatgtcatcttgagctcttcatttattttgactgtgatttattttgggagtgggaggcatttgttttttaagaaaaacatgtcatg

SEQ ID NO: 35622 - DNA, 354 bp, Homo sapiens
tggaccgggatacaaggaggagaaaataagcaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgat

SEQ ID NO: 35623 - DNA, 457 bp, Homo sapiens
gtagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattggcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccag

SEQ ID NO: 35624 - DNA, 159 bp, Homo sapiens
  misc_feature 159: n = A,T,C or G
cgactcttagcggtggatactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcn

SEQ ID NO: 35625 - DNA, 281 bp, Homo sapiens
  misc_feature 13, 18, 276: n = A,T,C or G
aatgggccgggangggangttacctctcttgcacccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcanatgac

SEQ ID NO: 35626 - DNA, 333 bp, Homo sapiens
ggggaaaaatcatatataacttagtgctagctagcgccacagactctagtagataatattatcatcataatggctggtgaaaccatataatcacagaaaaacattgccttcagcatgttcagttcgcagcactgagggtactcttgagggtgttgttaatgaagatttaatttttaaatacaggtggttccaagctttcaaataggttatgctccaaaagtgttatttgtaagttaatttttttacaagtcaaacaatgttggaagtggtttttaggttctagatcggtccacgaaagttagcccatatgtatatcttgaatagtttagggga

SEQ ID NO: 35627 - DNA, 240 bp, Homo sapiens
gggaaccgcctcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatg

SEQ ID NO: 35628 - DNA, 407 bp, Homo sapiens
ggggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaac

SEQ ID NO: 35629 - DNA, 185 bp, Homo sapiens
  misc_feature 11, 18, 25, 50, 55, 91: n = A,T,C or G
ccctgggaatntcggccntttattnggcccgggggaccgcttggattacnaagcntggccagcctcaggccagcagaagttgcaggaagancaaaggaagcaggaaaatgctcttaaacccaaaggggcttcactgaagagcccacttccaagtcaataaaaagcaactcctgcctcccttcctc

SEQ ID NO: 35630 - DNA, 334 bp, Homo sapiens
  misc_feature 325, 328, 333: n = A,T,C or G
gaattaaagtaactttctgaatgtgcatttcctgtgtgtggagagataaaaagagaataccttttcactaacttcctgttctgtgattaagagatcctgtcaataaacattttttcctttaattggaaaatctgaaagttaaggaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagnggncctana

SEQ ID NO: 35631 - DNA, 179 bp, Homo sapiens
  misc_feature 13, 20, 30, 45, 55, 76, 86, 87: n = A,T,C or G
tgggtttccctantcccccnttttgggacnacctaccaccaaatnttttcttaantactgtttggtttaaatggcntattgttgannaaaaacgccccctgaattcccctaggtgcccaaaagggttcaaactttaaatgtattattacccctgaaaaaccccatgccattttgtgcct

SEQ ID NO: 35632 - DNA, 429 bp, Homo sapiens
  misc_feature 14, 21, 34: n = A,T,C or G
caatttattggccngggcacnaggcaaagaagangcctgccaataactatgccccgagggcacctacacccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaata

SEQ ID NO: 35633 - DNA, 424 bp, Homo sapiens
  misc_feature 12, 15, 56: n = A,T,C or G
agggatgtctcnaanttggtggtattggtacctgttcctgttggcccgagtggagnctggtgttctcaaaccccggtattggtggtcaccctttgctccagtcaacgttacaaccggaagtaaaatctgtcgaaatgcacccatgaagctttgagtgaagctcttcctggggacaatgtgggcttcaatgtcaagaatgtgtccgtcaaggatgttcgtcgtggcaacgttgctggtgacagcaaaaatgacccaccaatggaagcagctggcttcactgctcaggtgattatcctgaaccatccaggccaaataagcgccggctatgcccctgtatttggattgccacacggctcacattgcatgcaagtttgctgagctgaaggaaaagattgatcgccgttctggtaaaaagcctggaaga

SEQ ID NO: 35634 - DNA, 270 bp, Homo sapiens
  misc_feature 3, 7: n = A,T,C or G
aanttanggctcttatggactcggggaatccagatttgcaactgtaacatgtataatatctcttcctttacaactgtcccacagaactcaaactgcctgccattcaaacaaactcctattcgttctcagctaccaccagacccagctcacagcctatagcctctcagggaatatttgcactttaagctaaaaatttaagggttgttatccaacaaccctctaaattaggaatgtttaggctgtatgcttcttagaaagaagaaatcaact

SEQ ID NO: 35635 - DNA, 102 bp, Homo sapiens
  misc_feature 12, 14, 17, 28, 29, 36, 51, 55, 56: n = A,T,C or G
tcgttaagtaantngantgttaccaacnnggggtantttactcctagttcnaganntcaggtaatgccttcctgcaggaagtgaagtttcctagatttgagc

SEQ ID NO: 35636 - DNA, 171 bp, Homo sapiens
  misc_feature 2, 3, 9, 16, 18, 25, 31, 34, 35, 38, 39, 46, 47, 55, 69,77, 91, 95, 100, 110, 126, 141: n = A,T,C or G
annaacccnagtaaancntaccccnttttanccnntcnnttgggannaagtagcnctccccgtacttantactttcnaccaacaaatcccntaantcccntaaatacccnaacttactcttccccntaaattggaaaaacnaaaaatacctcaaaaatggggccccataat

SEQ ID NO: 35637 - DNA, 498 bp, Homo sapiens
  misc_feature 13, 25, 35, 36, 43, 50, 51, 52, 66, 68, 357: n = A,T,C or G
tacccccgggaanctcggccaattngggccggganntgccccncttggannntcggtggtgctgancnggaattctttgtggacattggccccagtctgtttcaaataaatgaacctcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggnaaaatgtcaaccctttgtaagaaaaccaaaataaaaattgaaaaataaaaaccataaacatttgcaccacttgtggcttttgaatatcttccacagagggggaagtttaaaacccaaacttccaaaggtttaaactacctc

SEQ ID NO: 35638 - DNA, 369 bp, Homo sapiens
  misc_feature 14, 15, 25, 26, 28, 38, 43, 45, 51, 52, 64, 65, 66, 73, 102,104, 126, 150, 190, 213, 217: n = A,T,C or G
aaaaccttagcccnnaaacttccanngngccaccttantgaanantggccnntgcttcaaaccnnnccttccnagacagggccccttccccttggtcttccnangggccccccccacccgagggtntccccaaggggcctttgggaaganctttcccttcttgggtaaaacaatttcccttcccagcccntcccccttcccccttggggggancgcncaaagggaagggtgggggcccaccaccccccagggaaaggggaaaaagccgggcagccccccgttttgggggaacgttgaaaccgttttaataaatttttttgcttgaattcctttacaactaaataacacagatattgttataaataaaac

SEQ ID NO: 35639 - DNA, 363 bp, Homo sapiens
  misc_feature 9, 15, 351: n = A,T,C or G
gagggccgnagcacnaggtaccgtgggccgggccggatcgtggtggctgcgcttgcgaaggaccctgaggtagattgggtggtttcaacaggaaccgccatccactgtctgagagtttaaacttgattttgtgaggggacgaacagcgtgacaattaaagaagatctgggaatcaaaagcttcctgaggccttcaccagaagcagatgctggtgcccgtgcttctacagcctgcagaactcagagcaactgggaacctaattctgaccaacaaggaggaattgtttggctaatttgggaagtgacagaaaccttgggagaaagcaaccgcataccaaggataattataagnaagaagagaaga

SEQ ID NO: 35640 - DNA, 500 bp, Homo sapiens
  misc_feature 18, 19, 27, 31, 32, 37, 41, 54, 68, 73, 77, 78, 84, 100,147, 263, 313, 321: n = A,T,C or G
acccttcgctttcgttcnncaggcccnaaannaaganctcnggggttggaggancgctttcccgcccncggangganngggtanttggtccgggggtgantagtccctttgctttcccggaaaagggccgaagcctgagccatttantggggtttagggtgagggaaaccctcgccctctttctattaccggtaccgccgccgaatggggtggttcccctgatgccattgaaacttacaccgtttcacacaccgggaccagancgccttgctttagttgaccgcatgaagaccggtccggtcttttgcggaanaaagtggnttaaaagctgacttgtgggccgagaaactgtggcaccctaatgagctagggctagacgcttcgaccaccacgccaagtgattctgaagatctctaattctgtcaaggcgagagcgctccaacacgtgttcatcggctgttgctttttaagagaagcaaggaaggaagtcttgcttttct

SEQ ID NO: 35641 - DNA, 496 bp, Homo sapiens
tggctcgggatgaacaaacctgagaaacagctaaaccaaaagacagagctactaattctaaagcgacaactcctaaacctcaaaagccaaccaaagcacccaaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatg

SEQ ID NO: 35642 - DNA, 324 bp, Homo sapiens
  misc_feature 4, 6, 33, 181, 197, 224, 252, 258, 307: n = A,T,C or G
tggntngggggtctttaacaactctgtcccttngctcctgggacttctcatctagtagggaagccagcccttgaacaagagtgtagaaaatacatctgcctgtggtgaaaccccgtctctactaaaaatacaaaaaaattagctgggcgtagtggcgggcacctataatcccagctactcnggaggctgaggcgganaattgcttgaaccggggaggtggaggntgcagtgagccaagatcgcgccactgcngtccancctgggcaacagagcgagactccgtctcaaaaataaataaataaataantaaataaataaataaat

SEQ ID NO: 35643 - DNA, 304 bp, Homo sapiens
  misc_feature 4, 7, 32, 38: n = A,T,C or G
tatntantgggcccggggctttcaagcaaacnagcgancgccaagatggcagccccccacgggcctcgggagtaaaagtccctcgcaatttcccgactgttggaagaaacctcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgt

SEQ ID NO: 35644 - DNA, 346 bp, Homo sapiens
  misc_feature 30: n = A,T,C or G
ggaggaggaagagtgatgagttctctaatnacttggttggattagccttagagttatcgggagttgccttctgtaagtgcccctactatcaaggtttcatggaaaatctaggcaaggcagaacttcctcagaaggacaagagacaaagaagtgggggaggccctcctatccatagctgagagggtttattctttgtggttctgctgtcagagcctttggatgtctgatctgagatggagcaaccccagctagacagaactttgtagattttggggggtttaaaaggcctcaagcaaattctaaaactttctttgaaccccctggcataggctcagtttccctgact

SEQ ID NO: 35645 - DNA, 444 bp, Homo sapiens
  misc_feature 2, 4, 62, 411, 443: n = A,T,C or G
anantagcctgccgggccccgcaagtacagcccctgggtacaaccacccgaggtgggaagancaagtggatctggctgaagtgaacgggcccgccttctgctccagctgcatcacagtgatggccaagctgcatcagccgcactctcctggacgcccatatagctttaagatcgggggagggtaaataatgcaaaaattgcacagtggaagaaggggtctcacaaaaagcaatccatcctgtagtataggtaatgggagttgggggaagcagcttccattctggatgtttggaaccctttagctttgttttggaatggcccaccattctcactggaaaacagtggtctgctgtgaaaggccagctctcggcagcccctgtggtttcagcgctgctgctctgtgccattcangttgtgcacattgtttttcttctgacttccana

SEQ ID NO: 35646 - DNA, 383 bp, Homo sapiens
  misc_feature 3, 13: n = A,T,C or G
aancaggtgtgtntggataggggggaaggaagaaggggaaccagcagactggcaggtttacccctcatgtgcacatgaagttgccacttttgtaagttacaagtgaatgcatgttggcaatttcatatggttcaacttactgggtgtctggagcaacctcagcctcttagctacacacacacttggtgacagacaccaagcaggccagagtgcccagacggtatgtatgagagcacaggacagcgccatgcttcccacacacagagctctgagacctgcagctctgacaagagatgtcctttaaagagtctccactttccggagctccaaaactccctacaaggtcaccactctgctggtaaggatgaggggggaaagtgaga

SEQ ID NO: 35647 - DNA, 354 bp, Homo sapiens
  misc_feature 2, 11, 23, 24, 28, 49, 57, 58, 64, 74, 92, 113, 181, 203,305, 325, 327, 347: n = A,T,C or G
cnggggccganggtttaaaaaannttcnaaactgcctgccaggggtaanttttaaanntggtantaaaaaatanttagtaaagaaaaaaagntattgtatttgccactacctntagctagaaatagatcaccaaccattaccaaattcaatttcagtgccatgcctttagggtgttaagcnctgagattgtacatgtttactngttaggtccttgcatctgtggtgctaggtgagtatgagaaagatgtcaaggactggacgtattttgttgcctaaaaaaaaaaaggctgtttgtaggcgtttnaaatatgcttattttggggngnctctcactacctattacacnctgttgc

SEQ ID NO: 35648 - DNA, 376 bp, Homo sapiens
  misc_feature 14, 21, 27, 44: n = A,T,C or G
taaaccggggaacnagccacnaggaantaaagttagtgaagaanaagagggtgggtcctggatgaccagtgttttcattgcagttaaagaaattggtcgtgatctgtacaggggccttgcctacagaggaaaggatccagaaactagagttcatgttggataagctacagaatgaaattgtcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttaagaaaagtctgtctttagaccagcact

SEQ ID NO: 35649 - DNA, 447 bp, Homo sapiens
  misc_feature 7: n = A,T,C or G
tcggccntttatggcccgggatcatttcggaaatgaccctcatggatggagatacattggattttaactttgacaatgtgttgcccaaccaaagcttcccacacagtgtcaagacaacgacacatagctgggtgtcaggctgagggttagtgagcaggtaagttcaccccaatatcaaaagaccttttgaaaaatagaacttaaaagcgaggaacacagtaacttgccatggttagcacatctttgatgtcaactgactgtcccttgcagagagggatcttttatcattcattctctgtcctttttgcagcttacagttttccttctgagcttacacagaaggaagcttcctttaactgctttaaagatttctttttgacagttcgatggctgcatctttttagtagctcttcaataaatgaatacatttgatataaatcaaatgct

SEQ ID NO: 35650 - DNA, 321 bp, Homo sapiens
  misc_feature 2, 28, 35: n = A,T,C or G
antgggcccgggggttccttttaccccncgaaganatcaagatacaccttgtaaataaagctgatagcatattatttcataccctgttgtacaccttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagaggggatgcagtgcctttccccattcattcctgatggaattgttatactaggttaacatttgtaatttttttctagttgtaatg

SEQ ID NO: 35651 - DNA, 282 bp, Homo sapiens
  misc_feature 2, 4: n = A,T,C or G
gnanttttacccaaagtcattcaatacaacccagccccaaccattcggtccacaccctgggcattttggtgagagtcaaagctgaccatggatccctggggcccaacggcaacagcatgggccctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtc

SEQ ID NO: 35652 - DNA, 481 bp, Homo sapiens
  misc_feature 307: n = A,T,C or G
gcttctcttcctcggcgctgcctacggaggtggagacatctccttctcggcatcatggccgccctcagaccccttgtgaagccccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaagganctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgaagttaggcagcttcatgtgcac

SEQ ID NO: 35653 - DNA, 438 bp, Homo sapiens
  misc_feature 4: n = A,T,C or G
gagngcgagccgtctcgcaggccgtaggaggaagatggcggtggagtcgcgccgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaagggagattggcagcaccatgtctggcagaaaggggactgatgattccatgaccctgcagtcgcagaagttccagataggagattacttggac

SEQ ID NO: 35654 - DNA, 482 bp, Homo sapiens
  misc_feature 3, 12, 31, 34, 36, 37, 43, 63: n = A,T,C or G
aanctcaggccnactatgggcccggggggangangnnagcgantttaaaattgtatttgaaangggcatattaaaatgcattctgtacccctgatctggcattatagcttcaaaactgcagtggcgagtgtccatctcttagttagctacccttaactgtccacccttactaccctgtgggatcgttgcctggtttgtcttctctgtgtcctggagcaaagccagttcctaaaactaaaactccattctagtcttgggaagaaaagtttctactcagaactggggaagggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagagggtgcttttcttcataaaacct

SEQ ID NO: 35655 - DNA, 149 bp, Homo sapiens
  misc_feature 2, 30, 31, 36, 44: n = A,T,C or G
tntgggccccgggccagtatctgtaaagannctagntcccggancttgcctgtgtattattgtaaccgttaaatgaaaaaagaaccccccctttgtattatagtcatgcggtcttatgtatgataaacagttgaataatttgtcctcag

SEQ ID NO: 35656 - DNA, 231 bp, Homo sapiens
  misc_feature 48, 57, 62, 63, 67, 70, 74, 76, 81, 86, 91, 93, 98, 119,138, 186: n = A,T,C or G
tgcagtggcttacacctgtccacctctgcctcccaaagtgttaggatnacaggtgtnagccnntgcnccngggntnttatnaaagnaaacngntatantaagttactgggcattctcantacttgaatatgggacatntgctcaggggaaggaaataacattgcactttataaacactgtattgtnagtggaaaatgcaatgtcttaaataaaactatttaaaattggcac

SEQ ID NO: 35657 - DNA, 127 bp, Homo sapiens
  misc_feature 34, 41, 51: n = A,T,C or G
tctgaatctcttcaaattaaattcggtaaaaacncccttanttttttccantgtgatgtattcatgcagaacaactatctttgtattttgtttttaaaatgtgtttaataaatgatcctttgtaaat

SEQ ID NO: 35658 - DNA, 136 bp, Homo sapiens
  misc_feature 28, 41, 60: n = A,T,C or G
tccagtcctaaaccagttttgcccctgnctggtatttttantagtaacccattttttccntttgggacctggttcaagccaaaaaaagggtaacctaacctgcttcatctccttttgcgcttatttggaaatttta

SEQ ID NO: 35659 - DNA, 412 bp, Homo sapiens
  misc_feature 19, 34, 63, 77, 84, 89: n = A,T,C or G
aattaatgggcccggggtnctttccaaatcttcngtcacttcttaggaactcttgcactgaangggcctgacctganccttgangtccntttcattccccacccttctcacaagttccggacttttctcccctctctttctaagagaacctgaacctgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtggtgtgtcctacacaatggtgctattctgtgtcaaacacctctgtattttttaaaacatcaattgatattaaaaatgaaaaga

SEQ ID NO: 35660 - DNA, 341 bp, Homo sapiens
  misc_feature 8, 9, 68, 87, 130, 235: n = A,T,C or G
ccctggannttttttttatgagaaaaaatacctgtatttaaaatgtaaaataaaccttttaaaaagcnggccacctaattattatantttcttcccagccctttgattaccaaatttgtcccttgccccntgttaagatgaattatctcctaaaaatatcattgttcttgggagcagtgtatgttactttacatagcagcggttccctgtcatgtgttcatgtcagaaatttttngggttttaaactttcttattgcctttggctgttgattagtacagtacaagtgcgatttcaaaaagatcttgaaagtaatatatttaatcaattaaaatgtttatct

SEQ ID NO: 35661 - DNA, 325 bp, Homo sapiens
  misc_feature 4, 8, 49, 53, 55, 73: n = A,T,C or G
gccngaanaaaatgcccaaaactcttcggagctgcgtgcccattgagantganancaccaaagtgccgaaaanttacctttcaatggactgaacccagatgattgtcatagaactgggcaccaatccgctgaagagctcaggaattgaaaatggggctttccagggaatgaagaagccctcctacatccgcattgctgatacccaatatcacccagcattcctcaaggtcttcctccttcccttacggaattacatcttgatggcaacaaaatcagcagagttgatgcagctagccctgaaaggactgaataattggctaagttg

SEQ ID NO: 35662 - DNA, 284 bp, Homo sapiens
  misc_feature 7, 13, 27, 40, 43, 44, 46, 49, 72, 73, 77, 79, 256: n = A,T,C or G
actaatnggcccngggaagtttccccntttttttcccccntannantangggggtcctccgcccgtgttgcnnagancngtctgtattcaatggcctattcttcacaggtgtgatcatacccacattcaccttctgaaacacctcttgttgcgatcgctaacctcactgggacagagaaccgcagtctttcgagaatggaggctcttcattttttttttctcctttactccaaactcagccctccagtttcttcanatgtaaaccctgttaacgtcactgtttc

SEQ ID NO: 35663 - DNA, 211 bp, Homo sapiens
  misc_feature 3, 24, 62, 75: n = A,T,C or G
ganccctaaaattcgtagccaaanttctgtgggccagttttaaaaaagttaagcctgcctantagtaagttaccngggccatttcctcaatacttgaatattggaacattatgccacagggggaaagggaaaataacattgcacctttataaacactgtattgtaagtggaaaatgcaatgtcttaaataaaactatttaaaattggcacc

SEQ ID NO: 35664 - DNA, 249 bp, Homo sapiens
  misc_feature 26, 33: n = A,T,C or G
aacacaactgtagcttgcttgtattntagtatnaatcctattttttcacttgttaagtattgtgatgtttattcagattcagagattttctctgttgatgctttgtacatggtcatatccatccaacactgaatttgtagtcaccctatgtgaaacactttacaagaatgagaataaacgacctacaactgaaagcaaaagtatggatgagtcttacacatatacgttgagctaaagaattaaggcaca

SEQ ID NO: 35665 - DNA, 369 bp, Homo sapiens
  misc_feature 2, 3, 5, 8, 11, 14, 15, 20, 26, 39, 40, 44, 50, 51, 57, 60,66, 73, 80, 86, 87, 90, 93, 99, 102, 106, 133, 137, 156: n = A,T,C or G
anncnttntcnttnngggcnaacccnacctttttttacnnggtncgcccnntaagtntcnttcccntttttcntaagaanaggtcnntanttngggaantcnctantaagttattggtaagccccttttttcnaganctgggcctttcctttttcnacctttaaataaactattgccaaatttaaagggtttcccctcccattgttccatttttcatgggccctaaatagtgccattttatttttaagcacctgaataatacctcccattgtctagatgaattaggtttatcccattcaccctatttgaaagacttcttgggggggtttccaaggttttggcaattatgaataaagcctggtggtaaac

SEQ ID NO: 35666 - DNA, 188 bp, Homo sapiens
  misc_feature 3, 4, 13, 17, 23, 27, 28, 37, 40, 41, 58, 60, 62, 64, 68,69, 74, 75, 81, 84, 86, 96, 112, 116, 118, 185: n = A,T,C or G
ganngaaagtaancgcnagcctnagcnntggccgaanaannttaaattggtgaaattngncnanggannaccannttggantcnantccgaccacnttccgaaaccgccacnttgncnggcccccccggggtttccctcccccgggggcctaccgcccctggtccttgaagccgtccgcctttgnccc

SEQ ID NO: 35667 - DNA, 131 bp, Homo sapiens
  misc_feature 2, 4: n = A,T,C or G
ancnaggggtggggcagtttttgtctgctgtaagtgtcttaaccctagggaagggttaaatggctttttatactattgcatcttctgtatttacccatcaattcattgtgttgtaattaaaagaaactggc

SEQ ID NO: 35668 - DNA, 317 bp, Homo sapiens
atttctaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttggggtgtttttcatgttttagcatttgtataaagaaactggtccatgtaaatactttccatgttttttcttcaaatgtttaaac

SEQ ID NO: 35669 - DNA, 351 bp, Homo sapiens
  misc_feature 4, 16: n = A,T,C or G
tgtnttcgtttaaccnaaatctgaaggtcatctggtaacctcatgggtttttggcctcataagatggtccactctgtacacaggcattcctcctgcaataatgttgtatctttgagacccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatgggatgtgaccttggtttttgaatggttttgtattatac

SEQ ID NO: 35670 - DNA, 238 bp, Homo sapiens
  misc_feature 7, 14, 29, 34, 35, 48: n = A,T,C or G
cggggcngggtganaagcttggttgtccnaaganngaatcttagttcnacctttaaatttgcccaccagaacccctctaaatccccttgtaaatttaacctgttagtcccaaagaggaaccagctctttggacacctaggaaaaaacccttgtagagagagtaaaaaatttaacacccatagtaggccctaaaagcagccaccaattaagaaagcgttcaagctcaacacccactacc

SEQ ID NO: 35671 - DNA, 297 bp, Homo sapiens
  misc_feature 5, 8: n = A,T,C or G
atttnttngctcggggcctcaccctctggtgatagacacagttgttagtcaaataattataaaatttgactagtcagggaagttggaggaggctttcctgaggacgttgtgtttgaggtaggagctgaatgatgagcaggtgaagaggagagggaagtccatcatcccagaagggagggtccacatatgaaaaagcccagtggtaggagggcacatagtaggccctaggaaattcaaagcaagatgcctgtatgtctgaagaacagaatgcaggaggggcacatgggagaggggaga

SEQ ID NO: 35672 - DNA, 357 bp, Homo sapiens
  misc_feature 3, 12, 26, 27, 36, 37: n = A,T,C or G
ccnggcggtgancgacctaacgcacnncgaagtaanntgccctctcgccaaaggatctcccttcatccctctccagaagaggagaaagaggaaacaccaagaagaaaccgccctggtgcagagcccccaattcctacttcatggatgtgaaatgccccaggatgctataaaatcacccacggtctttagcccatgcacaaacggtagttttgtgtgttggctgctccactgtcctctgccagcctacaggaggaaaagcaaggcttacagaaggatgttccttcaggaggaagcaacactaaaagcactctgagtcaagatgagtggggaaaccatctcaataaacacattttggac

SEQ ID NO: 35673 - DNA, 119 bp, Homo sapiens
  misc_feature 3, 8, 10, 15, 22, 28, 31, 39, 43, 49, 50, 51, 67, 77: n = A,T,C or G
ggngcccnanggaanggggttnaggganccnaacctacnaaanttaaannnggtttgggtctggtcnaaaatgggtnaaggtggtgggtttccccctaaaccttttctgtttttccctg

SEQ ID NO: 35674 - DNA, 355 bp, Homo sapiens
  misc_feature 310: n = A,T,C or G
ggtagtttatgctacccaatcctgtaagaatttatctgcataactagatagaatttatccagcaattgactgaatatcttatttgttggatttatgtgcattctaataacatttggttcttagttccaatagtgtgtataaatactaaatataatatttcataccaggaccagttattagagaatatcatcagataactataatttgtactcttttatctacttttatggctgactcacattgttttcccccccctctttgccatttgtttactatattccaaattgtttttaaacagttacacaagggnattatgtcccttggggaatggtccgttacattttgaatatcagtg

SEQ ID NO: 35675 - DNA, 227 bp, Homo sapiens
  misc_feature 5, 6, 97: n = A,T,C or G
gaganngaggaagattgagcctgggggcaaccagcccaagcctcaccctgggcaggtctctgcccaccctccttgctctgtgagcctgtcagtctangttattctctttttttgtggctatttttaattgctttggatttgttaaatgttttctgtcttctgttaagtgtgttttctctggagatagaatgtaaaccatattaaaagggaaaaagtttcagacaaac

SEQ ID NO: 35676 - DNA, 235 bp, Homo sapiens
  misc_feature 3, 20, 25, 34, 46: n = A,T,C or G
atnggcccgggggagtgtcnagganttcgagtanacaccctggccnacatggtgaaaccctgtctctactaaaaatacaaaaattagccaggcgtggtggcacgtgccctgtaatcccagctgctggggaggctgaggcaggagaatcacttggacccaggaggcgaaggttgtagtgagccgaaatcacgcccactgcactccagcgtaggcaacagagcaagactccatcacg

SEQ ID NO: 35677 - DNA, 388 bp, Homo sapiens
  misc_feature 7, 18, 50, 63: n = A,T,C or G
gttttcntaaggtgcccnttcccttggtaggaagcctttattagaagccnaaataaagaaganctattgatggccctaaaagaagaatttcgtaaagaatttacccaagcctagaggaggttctgactaataagaagacgaccttctttggtggcaattctatctctatgattgattaccctcatctggccctggtttgaacggctggaagcaatgaagttaaatggagtggtgtagaccacactccaaaactgaaactgtggatggcagccatgggaggaagatcccacagtctcagccctgcttactagtgagaaagactggcaaggtttcctagagctctacttacagaacagccctgaggcctgtgactatgggctctgaaggg

SEQ ID NO: 35678 - DNA, 229 bp, Homo sapiens
  misc_feature 6, 27, 33, 34, 44, 59, 62, 63, 70, 71, 79, 81, 97, 113, 134,138, 152, 193, 202: n = A,T,C or G
aaattnggccccgccccgaagggcccnttgggnnaaaaaaaccngcccccaaaaaaaanaannaaggaannaaaaagantntaggaaaggcccaggnagaggttcccccaaangttaaaaaacccggcctttangccnttggttttgcccanccccgttgggggaaggggcccccccccagggggaaacccanggaaaaaanccctttgggggaaattggcccccagga

SEQ ID NO: 35679 - DNA, 318 bp, Homo sapiens
  misc_feature 9, 10, 29, 33, 38, 39, 40, 42, 49, 50, 60, 65, 83, 90: n = A,T,C or G
ctccggccnntttatgggcccgggggaanactntagannntntctcacnntaaagccccngttcnttcacccatttcctcctnttacccntttcagtgcagtttcttttcacattaggcctgttggttcaaaccttttgggagcaccggactgtcagttctctgggaagtggtcagcgcatcctgcagggcttctcctcctctgtcttttggagaaccagggctcttctcaggggctctagggactgccaggctgtttcagccaggaaggccaaaatcaagatgggatgtagaaaaggttgtaaaataggaaaaagtg

SEQ ID NO: 35680 - DNA, 370 bp, Homo sapiens
  misc_feature 12, 22: n = A,T,C or G
agttgagagaanggagccggancgcccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatggaaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcac

SEQ ID NO: 35681 - DNA, 383 bp, Homo sapiens
  misc_feature 11: n = A,T,C or G
ctccctaaganggaacagtggcatggagcagatgtatccatggaaaatgtctaagagtactagctgaatctaagagagctcagaatctctggctgggttgattggtgaaggattaaaactgaaggagataactccttcttcaaatgagaatacagtaatgtaagacttcaaagaacattaaataatcaagaaatatgataccatcaaaggagtacaataatattccaataatgagcctatcaaaaaaattaagatctataaattgcctggcaaattgccttcaaaagaattgttttaagggaacaattcattaagtgaatttgaatgtgctacaagaaaacacagaaaagcaactaaatgatatcagaaaaaaatacacgagc

SEQ ID NO: 35682 - DNA, 354 bp, Homo sapiens
  misc_feature 15, 19, 36, 103, 271: n = A,T,C or G
agaactttgccgaancgcntacgcccatgggtttantgggatacaaatgcctgcctataatccgctactttcagggaagccgccgaggggaccaaatgaaganctgaggggaagaaaaaaaatctctttttttctggaggctggcaccctgattttgtatcccccctgtagcagcattacctgaaatacataggcttatatacaatgcttctttcctgtatattctcttgtctggctgcaccccctttttcccgcccccagattgataagnaatggaaagtgcactgcagtgagggtcaaaggagagtcaacatatgtggattgttccataataaacttctgggtgtgatactc

SEQ ID NO: 35683 - DNA, 177 bp, Homo sapiens
cagggaaatgagagactcataaggcagtatgattagatagatgtcagagagagaattctgatgtgtggtgggctcatgcctgtaaccccagcactttggaaggccaaggcaggaggattgcttgagtttaggagtttgagactagcctgggcaacatggtaaaaccccatctctacc

SEQ ID NO: 35684 - DNA, 444 bp, Homo sapiens
  misc_feature 42: n = A,T,C or G
cgggaatttcggccatttatggcccggggatccgggcagagngcaatagcaggttcacgtacacctgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatcttcggtgttctattt

SEQ ID NO: 35685 - DNA, 412 bp, Homo sapiens
  misc_feature 16, 22, 44, 57: n = A,T,C or G
cgggaactttcggccntttttngccggggcctttcggcccgganccgcccatcttcngtaattcgccaaaatgacgaacacaaagggaaagaggagaggcacccgatatatgttctctaggccttttagaaaacatggagttgttcctttggccacatatatgcgaatctataagaaaggtgatattgtagacatcaaggggaatgggtactgttcaaaaaggaatgccccacaagtgttaccatggcaaaactggaagagtctacaatgttacccagcatgctgttggcatttgttgtaaacaaacaagttaagggcaagattcttgccaagagaattaatgtgcgtatttgagcacattaagcactctaagagccgagatagcttcctgaaacgtgtgaagggaaaatga

SEQ ID NO: 35686 - DNA, 211 bp, Homo sapiens
ctaacagatgaagctcaggtgggcgatgcgcctcaggcccagtgtggactgttgtaacccagcgagttatagagaaatgccacactttgagacaaattaaggaatcctttattatctggcgaccgagaggcagctaacgctcaaaattctctcggccccgaggaagggggttggttttggttttatacccgtggtctaaataggggagggg

SEQ ID NO: 35687 - DNA, 329 bp, Homo sapiens
  misc_feature 15: n = A,T,C or G
gcaccattcccgacngtgcatgatgatattcctcatcgctcagctgcggcctggccaagaaattgacctgctcatgcacctgtgtcaagggcattggcaaagatcatgcccaagttttcacccagtggcaacagccagttacaggctcctgccaggcatcaccctgcttgagcccgtggaagggggaggcagctgagggagttgagcaggtgcttctcacctggtgttatttgaggtgccaggaagtccaaggtaaaaaggtggccagagttgccaacccccggctggataccttcagcagagaaatcttccggaatgagaagctaaag

SEQ ID NO: 35688 - DNA, 297 bp, Homo sapiens
  misc_feature 10, 16: n = A,T,C or G
cattaagatnttgatnacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctg

SEQ ID NO: 35689 - DNA, 274 bp, Homo sapiens
aactttctaaaatctgcgataaacttatatgatagtagttgtaaaatgcttcttgttttgaaaatgttgagtaattatcgatagaaattttgctgtccattcatacattccttcaattaactttcattgttaaaaaattgggggattgatgtttggtttggtttgtggggagtgaagaggactactggagggaccttgtttgcttgctttttttctttttttaatttatcatcaagtctaggaaaggagtaagttgccgacaattgtcactttt

SEQ ID NO: 35690 - DNA, 342 bp, Homo sapiens
  misc_feature 17, 18: n = A,T,C or G
acccagggaattcggtnnttatggccggagaacacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggat

SEQ ID NO: 35691 - DNA, 203 bp, Homo sapiens
caagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttg

SEQ ID NO: 35692 - DNA, 254 bp, Homo sapiens
ctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaaga

SEQ ID NO: 35693 - DNA, 336 bp, Homo sapiens
  misc_feature 31, 38: n = A,T,C or G
caaatccataaatgtaatccagcatgtaaanagagccnaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatgctgaatggacaaaagctggaagcattccctttgaaaactggcacaagacagggatgccccttcttctcaccactcctattcaacatagtgttggaagttctggccagggcaattaggcaggagaaggaaataaagggtat

SEQ ID NO: 35694 - DNA, 301 bp, Homo sapiens
  misc_feature 17: n = A,T,C or G
gggaaaacatttatatncttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaagttgagttcattgtaaataattgtgaaagccactgttcaaataattttaagattacattaatttttctataaattggaaga

SEQ ID NO: 35695 - DNA, 277 bp, Homo sapiens
atggaccgggatttctcttagtttttgtttataaaatgtctttatttttcctttacttttgaagtatactttcaccggatatcagattttaggttgacagagtcttttgggggattttttgttttcattcagcactataaagataacttgccattttcttttggccgctggtatttctgataagtagtccacagttatatatatataaaattaatcccttgcatataatgtatcattatattttattggaatcaatcatattggaagtcatatattg

SEQ ID NO: 35696 - DNA, 328 bp, Homo sapiens
  misc_feature 32: n = A,T,C or G
aagggaagcctgtgatgactacagactttgcnaacgctacgccatggtttatggatacaatgctgcctataatcgctacttcaggaagcgccgagggaccaaatgagactgagggaagaaaaaaaatctctttttttctggaggctgacacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccat

SEQ ID NO: 35697 - DNA, 267 bp, Homo sapiens
  misc_feature 32, 211, 216, 230, 248, 256: n = A,T,C or G
ggaagcctttgtaagccttgattgcgaaagtncaaattttgatgtggggctataacatgacacccttggattgcgactggttttatacggcctgcctataacgttgaaaatccatgtactacataataattcagaagggctctattcactacacagattacattgttcaatcatcagctgctaatagcctaagatttattttttttttttnttaancctatggaaccggntttgctgttctggggggngaaaatanactaactcctg

SEQ ID NO: 35698 - DNA, 299 bp, Homo sapiens
  misc_feature 2, 25, 99, 151, 152, 177: n = A,T,C or G
gnaaagcaagggtggcgagaagaanaagggccgttctgccatcaacgaagtggtaacccgagaatacaccatcaacattcacaagcgcatccatggagngggcttcaagaagcgtgcacctcgggcactcaaagagattcggaaatttgcnntgaaggagatgggaactccagatgngcgcattgacaccaggctcaacaaagctgtctgggccaaaggaataaggaatgtgccataccgaatccgtgtgcggctgtccagaaaacgtaatgaggatgaagattcaccaaataagctat

SEQ ID NO: 35699 - DNA, 354 bp, Homo sapiens
gagagcctgcagctcttcagggaagaaatcaaaacgagatcacaagaatactgaaaaatgaagcctaaaatgaagtattcagccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatca

SEQ ID NO: 35700 - DNA, 142 bp, Homo sapiens
  misc_feature 6: n = A,T,C or G
agtccnaagaggaaacagctctttggacactaggaaaaaacccttgtagagagagtaaaaaatttaacacccatagtaggcctaaaagcagccaccaattaagaaagcgttcaagctcaacacccactacctaaaaaatccc

SEQ ID NO: 35701 - DNA, 321 bp, Homo sapiens
  misc_feature 8, 9, 26, 27, 28, 35, 55: n = A,T,C or G
ccggcttnntatggcccggggaaaannnctaaganaatttattaccctgcaagcnctatactagaagaaatgtaaaaggaaggtctccaagctgaggggaaataataccaaatggaaacttgagtccacagaaagggatgaagaactttggaaatagtaaaaatatgcgtaaatataaaactgtctcttaaatctcaacttaggtgaggtacataatgagtacctaaaccaaaaatagtgacattgttttgtggataatatggactgtagatgcaatacacatgacaactgtggcataaagggaagggaagtaaagggaac

SEQ ID NO: 35702 - DNA, 334 bp, Homo sapiens
ctgtacaaggccatcgaggagggagtgaaccacatgtggaccgtgtctgccttccagcagcatccccgcaccgtgtttgtgtgtgacgaggatgccaccttggagctgaaagtgaagactgtcaagtatttcaaaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtat

SEQ ID NO: 35703 - DNA, 345 bp, Homo sapiens
  misc_feature 16: n = A,T,C or G
atggcccggggtaagnaacaattaaatttatatttagtaagtcgataattccatatggaacctacctttgttttctaaaacaagtataggtctttacagaatgaagattaaatttacccttaagtttgtaaataacgaatagcattttattgagtcttttggactctttcaattgttagctatcttagagacactagttaataaaggaattccctcatcattagccatcaaaatagtccacttcccagagctgataaaaattctgtatatattaaatattagatttcatttttctgtaaacactcagttcactcatatctaatctactgataaatatagttatat

SEQ ID NO: 35704 - DNA, 431 bp, Homo sapiens
  misc_feature 1, 18, 39, 422: n = A,T,C or G
ngtaattttggccgggcnaggccgggattctggaaaacngtgcacttaaactgatcctgaagagagctgtcccagcacctctggccacccaggagggcccagattcccccagaaactacccttttgcccagagaacatgctcagtatttggggcatttcctcccacaaaccctgactgcttctgttaccctcagggccttggtacctggatactgccacagaattggggcgggtgggggaggggcctatttttaaataaaataactgttcaaagttgggggttttttaaaaaattaagaaaaaggaaagctattctgtatcgcaccttttcacaatttaatacattttcttacattttcctgtgattttcgaaactaaaccattgtgtgtcctgtagtgtccttggttgagctgccgctcancagcttcct

SEQ ID NO: 35705 - DNA, 378 bp, Homo sapiens
accgcaatctccgcctcccgagttcaagtgattctcccgcctcaaccaccctagtagctaggaatacaggtgcctgccaccacacctagctgatttttgtatttttagtagagacggggttttgccatgttggccagactggtcttaaactcctgacttcaggtgatccatctgcctcggcctctcaaagtgctgggattacaggcatgagccaccacactcggtcttaagccatatactttagatctatacccaatcagtgtggtagctcctagccagaagtagccacttaaacttagactaattaaaataaaatttaaaaattagctcctcagttgcacaagtcatgttttaagtgatcaaaagccacatatggct

SEQ ID NO: 35706 - DNA, 331 bp, Homo sapiens
caggtagaaacctctgatttggtagggaaggaagataaggatgaatgattaataagtaaaacattcattacaaaagcatgatgaatgtttactcagtgtccttaatgtgtacagattgttttaatattagaaggccatatagtttataagaaataaactagacagcaatcactaatcatagtccatgttttaatttagcatcggggttggcatatatgttgtttgctaataactgagtagagaatagttgccaatttccacactataatatatgttgcagccgagcacagtggctcactcctgtgatctcagcctcccaaagtgctgggat

SEQ ID NO: 35707 - DNA, 340 bp, Homo sapiens
  misc_feature 2, 3, 47: n = A,T,C or G
tnnttatggcccggggaggcattgaggcagcccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggagggaaaagataaaaggtttctaaaacatgacggaggttgagatgaagcttcttcatggagtaaaaaatgtatttaaaagaaaattgagagaaaggac

SEQ ID NO: 35708 - DNA, 436 bp, Homo sapiens
  misc_feature 6, 31: n = A,T,C or G
gcgganggactatcctgctgccaagagggtntagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaact

SEQ ID NO: 35709 - DNA, 233 bp, Homo sapiens
  misc_feature 3, 53, 231: n = A,T,C or G
ccnatctgggaagtaaggagaggattttgtacttaggagcaaagaaagaagtngcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtnac

SEQ ID NO: 35710 - DNA, 287 bp, Homo sapiens
  misc_feature 25: n = A,T,C or G
aagagggctgagctgagcttcggtnctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatat

SEQ ID NO: 35711 - DNA, 440 bp, Homo sapiens
  misc_feature 7: n = A,T,C or G
ctgtgcnagacacttgacattttatgtttcttctataaataatttattaggtacgcattcattctcaacttagagatggaaaaatttaaaaacaatcatagttgagcagtgacaatgagaagaataaaagtcatattcagattatttccttatatctactacatgtgttcatttcacaattgataagaccttcccatgtgtttgtaatgaattttatttccctacccctaggtagtttccatgcagagtaatgattgctgcacagaggcatttttgaaaagtgataaaaaatgcatttcaccaatttcagaagtccttgacagcacttgaagggtaatctctgtccaggcaaatggaggtaaatattacaagatgccagagtcaagagcacttcctcagcatttattccttccatgcccaggagaggattttatttcaga

SEQ ID NO: 35712 - DNA, 296 bp, Homo sapiens
  misc_feature 30, 31: n = A,T,C or G
gttgacaatcgagtagtactcccgattganncccccattcgtataataattacatcacaagacgtcttgcactcatgagctgtccccacattaggcttaaaaacagatgcaattcccggacgtctaaaccaaaccgctttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagag

SEQ ID NO: 35713 - DNA, 445 bp, Homo sapiens
  misc_feature 32: n = A,T,C or G
aaggaacggttaaaaaaagtaaaaggaactcngcaaatcttaccccgtctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatact

SEQ ID NO: 35714 - DNA, 303 bp, Homo sapiens
  misc_feature 5, 7: n = A,T,C or G
caccntngcccaagtccacaggccttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaatc

SEQ ID NO: 35715 - DNA, 261 bp, Homo sapiens
  misc_feature 32: n = A,T,C or G
aagttgaaggctcattgagatttgcagtcatnaatttaaagtgaaacccattggcatagctgggtgatttttcaccctagtttcagttaggttaagaaggtaataggaaccatcaggagacagggttataggggattttgttgatgacaggctatgattccccagagggaagaggtgtggaaggcaaggaaggttgagatactgagttggattagagaactatagataatgatgggaatatagcaagaccccattctccac

SEQ ID NO: 35716 - DNA, 395 bp, Homo sapiens
  misc_feature 6: n = A,T,C or G
attccnaggtattttatcattttatagctattgtaaatacaattgtgttcttgatttatttttcagatactttgctatattgcatttgtcaaagctatctttgagaatgttatattaatatttatacatattcatgcattttgtttttaaaaatggaatcatactcttataagacatcatgcttttctcaccaggcaatatattatgaatcttttcataaatataaataagcatttaaaatatattaaaaaagaaaaactactaattcttgtatattgattttgtttcctgcaatgtaacttattcctaatattcttttaaaatgttacttggataaggtttccagcaataacacagggaaaagaatagtgcctatttccacctgccatgtgaga

SEQ ID NO: 35717 - DNA, 291 bp, Homo sapiens
  misc_feature 9, 249, 271, 290: n = A,T,C or G
aagaagccncaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgttttttttttaaggaatgaggaaacaaaccaccctctgggggtagtttacagactgagngacagtactcagtatatctganataaactctataatgtttng

SEQ ID NO: 35718 - DNA, 142 bp, Homo sapiens
  misc_feature 6: n = A,T,C or G
gttttncagggattgaagaagtaaagtgcactgagttcagttttttaaaggtgcctttctgaagacatagctagtgaccgaggatttcctaagatctgtgagattgctctttattttctcctgttatattttttaagttggc

SEQ ID NO: 35719 - DNA, 126 bp, Homo sapiens
  misc_feature 2, 9: n = A,T,C or G
gnagagccncacattcttacagaggagatggagcgttatgagcatagtatgtggataggtatcttcacctgcccgcccctgagtcagcctccttgacttgatagcttgaagaatccttttccactg

SEQ ID NO: 35720 - DNA, 262 bp, Homo sapiens
  misc_feature 6, 26, 31: n = A,T,C or G
attcangacataagcatgggcaaagnatttntcggctaaaacaacaaaagcaattgcaacaaaagccaaaattgacaaatgggatctatttaaattagcatcagagtgaacagtcaacctacagaataggagaacatttttgcaatctacccatctgataaaagtctaatatccagaatttataaggaacttaaataaatttacaagaataaaacaaacaaccacataaaaactgggcaaaggatatgaaccgacacttctc

SEQ ID NO: 35721 - DNA, 107 bp, Homo sapiens
cggtcctcgcacccggcagccgccactggtgctgagctgctaggaagcccctatcgccgagctcgttggagcttgaacccattgtcacccctccgactcaccggccc

SEQ ID NO: 35722 - DNA, 388 bp, Homo sapiens
  misc_feature 2, 5, 6, 30: n = A,T,C or G
cnagnnaggatccgagaacgctctaagccngtccacgagcctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtg

SEQ ID NO: 35723 - DNA, 114 bp, Homo sapiens
  misc_feature 21, 22: n = A,T,C or G
gtcacccaggctggagtgcannggcaccatctcggctcactgcaacctctgcctcccgggctgaggcaggagaatggcgtgaacccgggaggcagagcttgcagtgagctgaga

SEQ ID NO: 35724 - DNA, 310 bp, Homo sapiens
tggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttg

SEQ ID NO: 35725 - DNA, 259 bp, Homo sapiens
  misc_feature 2, 5, 31, 57, 210: n = A,T,C or G
antcncctgtaaaagtaaagcctttaataangaaaagaaataaaagagttcatagtnaatccttttttatatttgtatatatttaaagtagcattaaataaacatgatattagtgtcaaaaaatctaggttcataaagatgttaatgattatgtttaatcagtgatgctatagattcttttgtcatttctataatgttggtatattgagntttgtttgttttgtttaggagtttgcttttggggtgtgtatgtgtgtgc

SEQ ID NO: 35726 - DNA, 239 bp, Homo sapiens
  misc_feature 5, 29: n = A,T,C or G
gaganttactgcaccggtcacctgagtantgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgct

SEQ ID NO: 35727 - DNA, 191 bp, Homo sapiens
  misc_feature 6, 8: n = A,T,C or G
caagancnagcccaaacaaaattagtggaaaataagaaataacaaagctcagagcagagataaatgaaattgaaatgaagaaacaggacaaaagatcaataaaacgttgggtttttgaaaagataaaacaaaacaaaacaaaacaaaaactgacacatcttttgccagactaagaaaaaagaagaccacat

SEQ ID NO: 35728 - DNA, 330 bp, Homo sapiens
  misc_feature 31: n = A,T,C or G
ggggtgacattcagccggcggttcggggcgncggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattat

SEQ ID NO: 35729 - DNA, 260 bp, Homo sapiens
  misc_feature 32: n = A,T,C or G
aagggaagattgtggagagaggacagtgcacntggtttcccccacatagactgcgtgggggtatgtcctgcttccgccacttccaactgtggcacttgggcacgcccctctcagggcaccttccctttttgtctccgcaaaatgaggttgtaatagtgcctgccgcactgtctggcacacagtaagctctcaagaaatgttagctgttgttgccgttagaacaccatagctagaataccatacctggcattcacttaaga

SEQ ID NO: 35730 - DNA, 280 bp, Homo sapiens
  misc_feature 8, 32: n = A,T,C or G
gaaagganaattttagcgtgctcactgacctncctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatat

SEQ ID NO: 35731 - DNA, 321 bp, Homo sapiens
ctgctcaagcttgtaatagataggatcaaatgagtaattaatcattaatttggcttctctaatactatagcttgacaagaggactagaacaaacaccctccagattagaggaggcccttagcccccctcttttctactctgcttcttatctgatcagctcctacagtatgaagtaccgagaaaaggcatcaactcagtggctcccagcatcagtgatttatgacagatgtccttagtggcaagagcaggatttagggatggtgatctatagcccacacaacattctaccagctaactgagtcagagatataatttggggtg

SEQ ID NO: 35732 - DNA, 287 bp, Homo sapiens
ggaatctgaagctggtctctggcttccatttcaagaagcaaaactgtctttgaggagaagttggcatttttctggtgagttacctgcccttttccaaggattttttttgagctgggagaatagcctgtggtactaaagaactttgccaggcattatggaatttttccctgtctgccaggccagagttcctgctctgtgtccagaaggatgtttttctattggtctgttccataacaggatccacagttgagttatacttggcaaaatcaaatgcagatgtgagggct

SEQ ID NO: 35733 - DNA, 355 bp, Homo sapiens
caaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttttga

SEQ ID NO: 35734 - DNA, 338 bp, Homo sapiens
tatggccggggtatggcgctcatttagattgtgattcaaactgtaaaagcaaaatgaaacttctgtaagacacttggggtacataggaacaaccaactgaatacttgatgatattaaagaatcattttcacttctttaggcataatgtacataagcttatgttctaaacatgagtttttatcttttagaggcacacactaaagaatttacccatgaaattgtatgaaatctggaatttgcttcacattaacatggatgagggtatagatgaaacaacatggccatgagttgataagtgttgaagctgaatgatgagcacatgagggttcattatattg

SEQ ID NO: 35735 - DNA, 341 bp, Homo sapiens
atgtgaataaactaggatttgacctcaggtctaagctcacaggttttgattattggttatttggaacatatttagaatattttagtatcaaagttttatcatttccttaaaacagatttaaaaaacagtttactatatttttacatatcacagtattacatttttaagatacttttctaaagcaatgtctctctaactttatagagaaagttagtgggaaataaaacccagtagaatatgcattttacctggtaagtctttctgaaacgtggcactaacattctgttacatgaagctttctgatgtacttgcctttttcgagcaaagggagtgattagagg

SEQ ID NO: 35736 - DNA, 327 bp, Homo sapiens
atatcatctccgtgaaggggatcaagggactgctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 35737 - DNA, 219 bp, Homo sapiens
gaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagc

SEQ ID NO: 35738 - DNA, 111 bp, Homo sapiens
  misc_feature 1, 11, 48, 61, 71, 83, 89, 94, 101, 102: n = A,T,C or G
ngcggccgagnttggtatcctgggcagggcttggcggctcacgcctgnaatcccagcactntgggaggccnaggtgggcagancatgangtcangaaatgnngaccatcct

SEQ ID NO: 35739 - DNA, 195 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgagga

SEQ ID NO: 35740 - DNA, 368 bp, Homo sapiens
  misc_feature 6, 7, 31: n = A,T,C or G
ggaganngctggtcagctttgctgactccantacatgctgctttgtgctgcttatgtccaaaccatatttgattgtatttgaatctttttcataaaaccagccttatacgcaattattgagcaatgattgttttcagttccaatccctcatgctaacccttgacttccttactgtgattcccctttagacttcaacagaaccccaggctaactggtctgtccttactcccttgacacttttgtgaattggttgtggataggaaattaactaattattgatcatgtattaacccattaacatattaattctctcagataacctattgctttaatacagtgagattatcattttaagattatggctactg

SEQ ID NO: 35741 - DNA, 389 bp, Homo sapiens
ggtaggagcctctctccctactgctgctactcaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaaga

SEQ ID NO: 35742 - DNA, 268 bp, Homo sapiens
ctcccttccctttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttac

SEQ ID NO: 35743 - DNA, 290 bp, Homo sapiens
  misc_feature 5, 6, 29, 184: n = A,T,C or G
ggccnngttctctttggagctgtgatcgntggagctgtggtcgctgctgtgatgtggaggaggaagagctcagatagaaaaggagggagctactctcaggctgcaagcagtgacagtgcccagggctctgatatgtctctcacagcttgtaaagtgtgagacagctgccttgtgtgggactganaggcaagatttgttcctgcccttccctttgtgacttgaagaaccctgactttgtttctgcaaaggcacctgcatgtgtctgtgttcttgtaggcataatgtgagga

SEQ ID NO: 35744 - DNA, 388 bp, Homo sapiens
  misc_feature 6, 31, 32: n = A,T,C or G
gggcanctcctgaagctgacagcattcgggnngagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcatttagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 35745 - DNA, 325 bp, Homo sapiens
  misc_feature 15, 42: n = A,T,C or G
atggcccggggggcnccatgcctttaggaaaatttcgtagcnttatgtttggtgtttaaagtagggaaggtctgagtgagagattgcagttaaaagctgtttattactaaagtgaaggccagttatcaggaggatctgaacagggaaggaaaatgggctgaaatcacaagtttgagttgacagctgaatgtttctagggagtcaaatatccctaggattcaaattgagttaactgggagtggcaagttgattgatagtagtgaggacagagagacagtcaaagaaaggttttagctctgctgaatatttagtcccaaaggaacat

SEQ ID NO: 35746 - DNA, 282 bp, Homo sapiens
  misc_feature 25: n = A,T,C or G
ctgcagtcagagtgtaaggtctgtntttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaac

SEQ ID NO: 35747 - DNA, 268 bp, Homo sapiens
  misc_feature 177: n = A,T,C or G
tgagacctttaattcatagagcaccaaatgcctggttgccgtactatgtagatacttgatattttgttgtaggtctcatagtccaaatggctacctgtacatgttttggaatgtagaaattatattcccattattgtataataagaaatacaatttataacttagtccaaataaagnttctaagtcgatattattcgttcatgttattatccaataagctacatgtgtaaacagggtataaatctgttcctcctataaaatggaagga

SEQ ID NO: 35748 - DNA, 139 bp, Homo sapiens
  misc_feature 31: n = A,T,C or G
gtccaaagtagaacagctctttggacactangaaaaaaccttgtagagagagtaaaaaatttaacacccatagtaggcctaaaagcagccaccaattaagaaagcgttcaagctcaacacccactacctaaaaaatccc

SEQ ID NO: 35749 - DNA, 313 bp, Homo sapiens
  misc_feature 5: n = A,T,C or G
gtgtncgacatgtgtatacatatgcaagtgttttcttttagtgagacttttccttcgctgtatctcattgtctctgaatttcaaatgaaaatcatgtatctagtcctttccctactttactttctcctttagcattgttttgagggctcgtaagaacatctagataccctgagcccttgaggagaagggttctgaaatcagtttcattctatttaatctatttcaaatgatttaccataaggttccttgacaatccttaagtggctgacaaggaaattttattagaatcgtattaatttttggctctttaaga

SEQ ID NO: 35750 - DNA, 251 bp, Homo sapiens
  misc_feature 30: n = A,T,C or G
ggggattggagatgtccccactgagagtanggcacaagtgaggaaatggtttggagaggaagataagttacatcatggacatgctgagtctgagttgcctatgggacttggaatggggggtggcaaaatgtgtgtgatcttgagcaagatattcaacccttctgggccttggtcttcttatttgtaaaatggcgataagaatattacttcccatttgtgttgctgtgaatattaaatgcgctaccacatgt

SEQ ID NO: 35751 - DNA, 349 bp, Homo sapiens
  misc_feature 31, 32: n = A,T,C or G
gttgcccgtcgcgcctaggcctttccctcannttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaataactatgcaaaaaatcaacagcagaagaaataccaagaggaggccattccagccttaagagatatttctattaagtga

SEQ ID NO: 35752 - DNA, 199 bp, Homo sapiens
  misc_feature 24, 39, 127, 188, 197: n = A,T,C or G
atatcctagagtaagataactatncataattctattgtnaaaaaattaatattggctgggcatggtagtacacgcctgtggtcccagctaaatggaaggctgaggtggaagaatcgtttgaacccangaattcaaggcttcagtgagttatgatcatgccactgcactccagcctgggagacaacacnagatcctgncg

SEQ ID NO: 35753 - DNA, 180 bp, Homo sapiens
  misc_feature 5, 10, 30, 35, 41, 42, 46, 52, 53, 54, 57, 59, 62, 64, 69,74, 76, 78, 87, 93, 94, 95, 118, 121, 129, 173, 174: n = A,T,C or G
aatcncatgnatcacgcacccacaccagantaagnttggtnnttcnaaatcnnnagngntcnanctgtntaggncnangcaaggtcntgaacnnntgaacttacgtgatccacgccanatnggcccccnttgtgctgggattacaggcatgcgccaacatgaacaggctaatnnttgttt

SEQ ID NO: 35754 - DNA, 241 bp, Homo sapiens
  misc_feature 239: n = A,T,C or G
aagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccanct

SEQ ID NO: 35755 - DNA, 265 bp, Homo sapiens
atccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcaga

SEQ ID NO: 35756 - DNA, 179 bp, Homo sapiens
tgataggattgcagttaagtaaacaatatgtgtaaaacacagtaaatgctcagtaaatttagttattaacatttctgccctgaactgcattacaatggattagttaagaaatgttagcaagtagctaatgcaaggccctatatgataaatacattaggaatacttgaaataaagaatta

SEQ ID NO: 35757 - DNA, 295 bp, Homo sapiens
aagaagcctattgctcctaggctacaaatctatacagcatgttactgtgctgagtactgtaggcaactgtatctaaacatagaaagatactcgtgtatccaaacaaagtattcatgtatctaaacatagatacagtaaaaatgcatatcataacctcatgaggtctgtcctgttatgtgccacatgactatattttaatacttaatgtttcagaaacagcattctaagagtgagtgaaatccaagcactttagaaggctgaggcaggcggatcacctgagatcaggagtttgaga

SEQ ID NO: 35758 - DNA, 249 bp, Homo sapiens
  misc_feature 22, 175: n = A,T,C or G
taagatgtgttaatggattatncatcttatttgttgtgaaaataacgactctctctttttaaattttatggtagaatgaacatttattcttgattataatttattgaataatagatacttgtcatttacaattaagcagaagttaaaatgtggtaactgttgaaaattgaaaatnagacagctatcccattttaaattgatgggtgcaaagtgtgtttctttctcttaggttaccattccatcaaatac

SEQ ID NO: 35759 - DNA, 301 bp, Homo sapiens
  misc_feature 5: n = A,T,C or G
ctcgntttttatggccccgggctcttcccggggacgttgtctgcaggcactttttaatggtccagcgtttgacataccgacgtaggctttcctacaatacagcctctaacaaaactaggctgtcccgaacccctggtaatagaattgtttacctttataccaagagggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccat

SEQ ID NO: 35760 - DNA, 385 bp, Homo sapiens
  misc_feature 3, 32, 33: n = A,T,C or G
ggncgcaatagatatagtacccgcaagggaanngatgaaaaattataaccaagcctaatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 35761 - DNA, 297 bp, Homo sapiens
  misc_feature 6: n = A,T,C or G
cattantctaaaaataatttcctctttttgggtatgtgaacctcattgtgaaaccaattaaagccgtggaccctcttccaagaaaggtgtacctatgctgatatgtatagaatttagcatatagtaggaagcagttgacagacccctctgaagcccattcatggggatcccttaggtttaaaggatttcatgatttgtctttttttgggacggagactcactctgtcgccaggctgcagtgagctgtgattgtgccactgcacttgagcctggacaacagagtaagacattgtttca

SEQ ID NO: 35762 - DNA, 287 bp, Homo sapiens
  misc_feature 8: n = A,T,C or G
atgaatcnagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaat

SEQ ID NO: 35763 - DNA, 246 bp, Homo sapiens
atccttttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtga

SEQ ID NO: 35764 - DNA, 114 bp, Homo sapiens
  misc_feature 6, 30: n = A,T,C or G
gaaaanaaaatccttttgaaactcgacttngtgtatacccaataatttaaaattatgtgaaatgttttaaatttgtgaactcgtaattactgttttaatgattcagtttcttca

SEQ ID NO: 35765 - DNA, 346 bp, Homo sapiens
  misc_feature 31, 32: n = A,T,C or G
aagggaagcctgtgatgactacagactttgnnaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattggtaagtaatgaaagtgcactgcagtgagggtcaaaggagagtcaacatatgtgattgttccatactaaacttctggtgtga

SEQ ID NO: 35766 - DNA, 169 bp, Homo sapiens
  misc_feature 25, 26, 51: n = A,T,C or G
tgaaattgaaatgagataagattcnngtatgagatgaaatgatgagatganatgaaatgatgagatgaaatgaggtgaaatgaaattagatgaaatgtaatgagatgaaatgaaatgacataatgaaatgaaataatgaaatgagatgaaataaaataatgaaatgacc

SEQ ID NO: 35767 - DNA, 265 bp, Homo sapiens
  misc_feature 18, 19, 33: n = A,T,C or G
cttatggcccgggaggcnnttgtatgtgaaagnagaaacacttttttagaaacacagcaagggagattttgaataaagagagagatgaatttataaagtaggaaaaaaagaatctgaaagatacaaagtgattataaaagaattgacaggacaataaatacttcaaatacttttaggaagtaaatgagtaggagtttaggagggataaacgagataaattccatgcaatgatcaaggaaagcaagagagcagataatacaaaaga

SEQ ID NO: 35768 - DNA, 329 bp, Homo sapiens
  misc_feature 18, 25, 28, 29, 46, 53, 57, 72: n = A,T,C or G
cttcttggccccaggganacccggnccnnatggcccgggaaggcantgaggcngccngcgccaggggccttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaac

SEQ ID NO: 35769 - DNA, 253 bp, Homo sapiens
  misc_feature 25: n = A,T,C or G
atgaaatgatatccccaaagttctnaaagaaaatgagtgctaagaaacaactattttccatgaataaaagtaaaatgaaaatattttcagtaaaaaattgaaagaggctgggcattgtgtcttatgcctataatcccagcaccttggaaggctgaggcaggaggatcacttgagcccaggagctcaagaccagcctgggcaacatagtgagatcctgtctctactcccttcaccctccaataatttgataaga

SEQ ID NO: 35770 - DNA, 116 bp, Homo sapiens
  misc_feature 14, 20: n = A,T,C or G
gttgcctaagaagnggcagncgcagaaggtagacccatgcggttcaaatccgtgttgttcaagggtccactctagaatttttatgaggagtctgttaagatgtaatgttaaatgta

SEQ ID NO: 35771 - DNA, 144 bp, Homo sapiens
  misc_feature 20: n = A,T,C or G
catttggaaaacaataaacnccaaaaaaatcccttcaggattaccagagttgaaatacctccagataatcttccttcattctaattcaattgcaagagtgggagtaaatgacttctgtccaacagtgccaaagatgaagaaatc

SEQ ID NO: 35772 - DNA, 364 bp, Homo sapiens
  misc_feature 32, 33: n = A,T,C or G
atcctatgttaacattatattaatatgttgtnnaaattattgtgcagataggaacagaagcagttacccatttagtttccataaatgaaaacgagcagagaaaatgatttgaaataactactccttacatattcgttttttccttcactgctaacagtgtgctttgtgttactaatcaagtcaaggacttgggttcatgctgcattcaactagctaatttaattccttttcagtactaaaaatgcccatccgagccctggcctgctgcctcaccaatatttatctttggaaccagttgaaagatcactgtgactatagtagcacaaacttagatctcctgtgaataaaaattataagctcatgc

SEQ ID NO: 35773 - DNA, 381 bp, Homo sapiens
  misc_feature 31, 33: n = A,T,C or G
ctgagcacgatacctaaatggaatagctaantntataaatatgtaacagaaaacataggtgagttatctttacaacgtggagtacattaagactttttttgacatggcccttgaatgtaattatcataaaagagaaactgataaagtagatgtcatcaaaatttaaaacttctgttcttcaaaagacaccattaagaaatgaatagccaagccacagactcaaagaaaataaccacaattttatatctgacaaaagaatgatacccaaaataagaaaatattgaggagaaaatattcacaaaacgtagattaaacaaaagaaaatgatacccaaatgtggtgggctgaaaaacatccttctagagatgtccatgtcctgtt

SEQ ID NO: 35774 - DNA, 180 bp, Homo sapiens
  misc_feature 2, 44: n = A,T,C or G
anggcccgggatagcatacaagcaagaagccttacagccctcantggcgaaaattttttcatgtcagagaccgagaactcttgcagtcgtttatgtcatcccttcttctccagacagaagataccaaaaagttgcaatcaaagatctcttcatcttattgataaagccactaataagcca

SEQ ID NO: 35775 - DNA, 395 bp, Homo sapiens
acggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagcggatgataatctcaagaaactaaggaagaat

SEQ ID NO: 35776 - DNA, 181 bp, Homo sapiens
  misc_feature 11, 14, 39, 42, 67, 180: n = A,T,C or G
tggcccggganagntctgtgtttcagcatatgacaaacnttnaggcagatggatgtctgatagcagncagtgcttgtaggtattctagttgatagtaatgacaaatcttttaaaaagtagatgattaactacagtgatgaagatacacagaaagacgatgagaaacagcatgagcagatng

SEQ ID NO: 35777 - DNA, 120 bp, Homo sapiens
aatattgatgtctagcatttctcaagcaaataacatgcgatgaaaataacaaagtttgtatactgacaattagattaatttagagattccaggttaactattagaggttttgaagaaatc

SEQ ID NO: 35778 - DNA, 281 bp, Homo sapiens
  misc_feature 7, 26, 178: n = A,T,C or G
accaagnatttcactttcaagatggnaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctctnacaatgtggtgaaacgtcttaaagtagagagtgaagaaaatgatcagaccttttcagagaaaccagcatcttccacagaggaaaactgtttggaatttcaaga

SEQ ID NO: 35779 - DNA, 263 bp, Homo sapiens
  misc_feature 175, 176: n = A,T,C or G
gtttcctgttaaaaaatcttaaagcccaaccttaggaatatagtgccccaaaaggcggatgcttcttccattatcttattttctttgatactttatttaattagatgtttataaagaaatgggtttatttttccagcataaacctcggaatttaaggaaagaaaatgatgtctgnnggatagttcattgttttgcctactcagcagaggtgatgactcttaaaaattggctttgaccaaagttctcttgttttcagggaaaga

SEQ ID NO: 35780 - DNA, 229 bp, Homo sapiens
  misc_feature 22, 174, 176: n = A,T,C or G
ctctatatctcctatctggtanataatactcacattacagtcagcagaacctgccttagtggcccgaagccagttggatccctccccgctgcccaggaggtagaaggaagaaaagagataagtgcctattattctccattgaaatgatgactacattttgccttgatggcgggncnagcagtgtatgttggtctttgtattctggtcagttctttcaattagaggagga

SEQ ID NO: 35781 - DNA, 231 bp, Homo sapiens
  misc_feature 24, 178: n = A,T,C or G
cagtaacagccaagatgctgcggnatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtntagagccaccatgattcttacagttggtggaacagcatatgccatatatgagc

SEQ ID NO: 35782 - DNA, 236 bp, Homo sapiens
aatgaaggagtcagaattagtctagccaagaagaagatgcgggaagggtctttcatgaagagaaggtagcatgagcaaaggaagacaggcaagagagaatcgccttgtagaggatcagcaagtgacttgatgtgcattaggtgaagtgagctgcttcaggaaagtaggatagaagtacatgtagggtgcatcttgaggaaaacttgtgagccagttgtagtaacataaatggtttt

SEQ ID NO: 35783 - DNA, 236 bp, Homo sapiens
  misc_feature 151, 152, 179: n = A,T,C or G
accatcggcagccgattccgtgtccttgatcacggggtgggagggaaccgtggcgtccctgcgtggggcccatgggtgagacactccagtactgagacctagagtccagatgcttgtaggagccaagtcgtgttctaagtatttatttaanncaaaagaatcacgttttcccatttggncttcagcgctagcccctgttttgcacagccgagtactggcgagtatgttctatgttg

SEQ ID NO: 35784 - DNA, 276 bp, Homo sapiens
  misc_feature 180: n = A,T,C or G
ctttgaaaaaatttttctgcatgcccaggtgtctgtctctggctgaggttttgtctattttacagtgtttcaatccagccataaaaattaacttgtgattttttttcccaaagtcatgcttttccttaattatatttttattttattattttagtgtcttgagaaaaataccaagagatntaatgtttcttttaattgtctatgcttaatcatctttaaacactttttaaatttctaaccacaagacctctctataatggtaaatgtaagacatca

SEQ ID NO: 35785 - DNA, 284 bp, Homo sapiens
atatatgtagctaatttttttgctacccttgtattcctaacactaagtgtgatgcttggcacatagtaggtgctcagtgtaaaataagtgtatagcaaaagaaggaaaacaaggaaaaattcagagaagacatgaaaacaagaccaaacatgcttgttaaaagtataaaggccccatgatatagcttagctattaagcaagatttacattagattaaatacaaagcccacctatgcacttagtgtttagaaacacactagaacaaaattactagggggattgga

SEQ ID NO: 35786 - DNA, 216 bp, Homo sapiens
  misc_feature 29, 30: n = A,T,C or G
gcgctcttcggcaccttttcctgtctcanntatcggaatgcggggtcgagagctgatgggcggcattgggaaaaccatgatgcagagtggcggcacctttggcacattcatggccattgggatgggcatccgatgctaaccatggttgccaactacatctgtcccctcccatcaatcccagcccatgtactaataaaagaaagtctttgagtagtg

SEQ ID NO: 35787 - DNA, 249 bp, Homo sapiens
  misc_feature 212: n = A,T,C or G
gggccccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaatncgatcataattctaacataaggtacagatgtagagga

SEQ ID NO: 35788 - DNA, 256 bp, Homo sapiens
  misc_feature 208: n = A,T,C or G
cacttaagaactgatgaatggaaactcaaattatgttttgactgagcctaatcatgttgacctgacttctctgagccttcatgttgtccctctctatagaatgtgaacaatattctcttgcaggcaggtttgttgtaaaattagatgatgcacatttaccctgtatggtctttgcgttacagcatatgctcagtaaatcagacctatnattttcctttcatgattgtacctctgagttggttctatcattagagtt

SEQ ID NO: 35789 - DNA, 204 bp, Homo sapiens
gacaataacagtacatcttttcaagttctcagctatttcttctacctctccctaccttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 35790 - DNA, 211 bp, Homo sapiens
  misc_feature 178, 179: n = A,T,C or G
cactgagctctaattaacttgacagaagccagattgatttttatgcagagacttttagtatagtagatttggagctagaagacctaggcttgaaccttggctgtttctcttattatttgtgtcacaaaatgtaggttttcttaatctgttttcttattagtaaagagggaatagtcannactgttgtaggttgttgtgaggttgttgcaat

SEQ ID NO: 35791 - DNA, 299 bp, Homo sapiens
  misc_feature 20: n = A,T,C or G
ctcactggtgtgagttccancatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccatatgtaaatagaacaacctgcacaacctggatttttttaaaaataaaacactga

SEQ ID NO: 35792 - DNA, 295 bp, Homo sapiens
  misc_feature 31: n = A,T,C or G
aggaccgtggaagtaagctctttgggagctnagattttgtttttcacacttggcattccttctggcacctggttctttgcacatattatgtgtaggcatatgataaataatcattggtaaaatgaatttttgtatactttggcaaggtttcattcaataaccagttacatgtgtcttaatacaagttacattttgaaaagtagattctaatttggtcattttagtaataatatatatttattttgatcactatatacggatggttctaggacccaaaaagatatatttaaatact

SEQ ID NO: 35793 - DNA, 229 bp, Homo sapiens
  misc_feature 15, 41, 42: n = A,T,C or G
atggcccgggcaganggagtgggcactagctttctcttctnntagggagggacccagcccccattgttctgcagccagagagaactgtcttggtgttggaggaatgattctggcctagggtgaggatatttaggtttacaacttgtgggactgtgacttaatttacccctttattggtttgtactcttggttgtaaatttcagaaattcagcccaaatcacttaagctc

SEQ ID NO: 35794 - DNA, 210 bp, Homo sapiens
  misc_feature 10, 17, 36, 45, 65, 72, 78, 84, 86, 87, 88: n = A,T,C or G
cagggaaatnccggttnttatggccccgggcacaancttcatttnggagttctttttgaagtatntaaggtncccgtngcattngnnntgtttacagataattacctactctggctagaagctaggggtcccagtgaagagccactgccattaaagaatatgaaacatagataaaacatctttgaaattatgtaaattatgtaaattatc

SEQ ID NO: 35795 - DNA, 223 bp, Homo sapiens
  misc_feature 7, 21: n = A,T,C or G
caggaangatcacctgaggtnggagtttgataccagcctgaccaatgtggagaaaccccatctctactaaaaatacaaaaattagcctggcgagttggtgcatgcctgtaatcccagctactcgggaggctgaggcaggacaatcgcttgaacctgggaggtggagattgtgctgtgcaccattgcactccagcctgggtgacaagagtaagactccgtctca

SEQ ID NO: 35796 - DNA, 279 bp, Homo sapiens
tcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgccgccctgtgggctgtgccaagtgtgcccagggctgcatctgcaaagggacgtcagacaagtgcagctgctgtgcctgatgccaggacagctgtgctctcagatgtaaatagagcaacctatataaacctgga

SEQ ID NO: 35797 - DNA, 248 bp, Homo sapiens
aaatcattctcaactcaccattcccaaacagcattttgggccaggcatgggggctcgcacctgtggtctcggcactttgggaggccaaggtgagggagtcatttgattctaggagttcgagatcagctctggaaacatataccccatctctacaaaaaggaaaaaagaaaaaagggggggccaggtgtggtggcatacacctgtggtactagctactcgggaggctggggtggggagatctcttgagc

SEQ ID NO: 35798 - DNA, 256 bp, Homo sapiens
ggtggcctcatgccctgtagtccggcactttgggaggccaaggcaggtggattgcttgagaccaggagtttgaagccaacatagcgaaaccccatctctactgaaattataaaaattggctgggtccggtggtgcacacctgtagtcccagctacgatgagaggctgaggcaggggagttgcttgaacgcgggaggcagaggttgcagtgagtggagatcacaccattgcactccagcctgggcgacagagtgaga

SEQ ID NO: 35799 - DNA, 254 bp, Homo sapiens
  misc_feature 179, 181: n = A,T,C or G
caaaagtacctgtacagaaaatctgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcngnaatcaaaatgtgatctagtgtaatgaaataaaatgtgatctagtgtaatggaagacctttgagaacctgggtg

SEQ ID NO: 35800 - DNA, 307 bp, Homo sapiens
  misc_feature 2, 4, 35, 42, 109, 161: n = A,T,C or G
ancncgattttgtgggggtttttctttcctgcttngagttanggcagcttctccaggaatcccagtcattttataaacatgggctcctgcttaagtaattatgcacctnactgaccttcagtttgggtgcatttgttagtgaactctcttgctgggggggngctggtagtattttccaaacagcttgttatttcttcctctgctaataactagcaagaacccaaagtaagcctctcttggtcatgctgcccaaagctcagtgggatcactccttgtcagcctgaccctatccataacatgactgtga

SEQ ID NO: 35801 - DNA, 268 bp, Homo sapiens
  misc_feature 177: n = A,T,C or G
acagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagntggaagatggccctaaattcttgaagtctggtgatgctgccattgttgatatggttcctggcaagcccatgtgtgttgagagcttctcaga

SEQ ID NO: 35802 - DNA, 244 bp, Homo sapiens
  misc_feature 178: n = A,T,C or G
catcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctntgaaaagtattccaacgtgatattccttgaagtagatgtggatgactgtcaggatgttgcttcaga

SEQ ID NO: 35803 - DNA, 352 bp, Homo sapiens
caaaagggaagctggaggtttttcaaggaagtccagtgttgacatccctccttcccttgggaacccacctcagttaatctgtgtgtccaatttaaatgcttccatttgaagaaaagcctgacttgtttattttctattgcagaaataaatttttatcatcaagtaatattaactgaatatacattatatgtaacttgtgttccctcagaaaactgatcacatgtatacaaaagcatcatattttgtatctttatttttaggtcaagcaattctgtaccccttagccacttagtttcatcatcatcatcaaacattttttgggttcctaaatatgtttcttcatgtttaatac

SEQ ID NO: 35804 - DNA, 269 bp, Homo sapiens
gcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaattagggacctgtatgaatggctccacgagggttcagctggctcttacttttaaccagtgaaattgacctgcccgtgaagaggcgggcatgacacagcaagacgagaagaccctatggagctttaatttat

SEQ ID NO: 35805 - DNA, 265 bp, Homo sapiens
cctcattgttcttacagatatcacagccactttcaccacaggaagaaagggtagggatttgtatcagtcttgttcatctcctttcatcagggaaggaaaagcttcttcagaatctccagaagattttcacttgtatctcaccggccagaactgtgtcacatatcaacacatacctgtgaatggagctggaaaagcacgtattacttggacacattattgtcagaacacaggaagggattatgatgccatagaaaaggggtgagtg

SEQ ID NO: 35806 - DNA, 156 bp, Homo sapiens
  misc_feature 24: n = A,T,C or G
gtaggcctttgtaaaattgacagngaggggaaaccccgtaaagtggttggttgcagttgtgtagtagttaaggactatggcaaggagtctcaggccaaggatgtcattgaagagtatttcaaatgcaagaaatgaagaaataaatctttggctcac

SEQ ID NO: 35807 - DNA, 181 bp, Homo sapiens
  misc_feature 33: n = A,T,C or G
aagggacgtccagtatcggtgacatcgtcacantgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 35808 - DNA, 337 bp, Homo sapiens
  misc_feature 30: n = A,T,C or G
agcctcagctgggaacatgtgtgctgggtnagtcaaattttttatctcattattcccagtagctacattctataatgttgctgcaaaaacagaattagcaaataatgaaacactactgctaagggaaatacagggtaaagttcctgtgaggctccggtcataacattttcacccaccaattaatatataaccttgtttcagatgtgtttctgtgtaataatactttaggtcatttacactgttgattcattaacattgaactcatggccaaaaccaccataactcatgcctaaacaaagcttatatctaacactcgcatattttctctgtaagacat

SEQ ID NO: 35809 - DNA, 295 bp, Homo sapiens
  misc_feature 24, 151, 177: n = A,T,C or G
caagacagtaaggattcaaaccanttgccaaaaatgagtctaagtgcatttactctcttcctggcattgattggtggtaccagtggccagtactatgattatgattttcccctatcaatttatgggcaatcatcaccaaactgtgcaccanaatgtaactgccctgaaagctacccnagtgccatgtactgtgatgagctgaaattgaaaagtgtaccaatggtgcctcctggaatcaagtatctttaccttaggaataaccagattgaccatattgatgaaaaggcctttgaga

SEQ ID NO: 35810 - DNA, 317 bp, Homo sapiens
  misc_feature 6, 30, 32, 209: n = A,T,C or G
tgctcncaaatggttaatcatgctgtgtgntngccgggccagctggtaccttctttgcctgagcattcaagggacggctaacctttattgacaatctataccgcaaaagtcaggaaagaggttgtgagctgattggattaaagacctggcacttcagtaactcagcacgcttccacttcactcaacttaagagagttcattgacagtgntaggatgtgaaggctgggaaacacttattttgcttcaagagttccacttggctctcccaaataggtacctcaaaaactgttagcaagcggcatttggatgtcttgaca

SEQ ID NO: 35811 - DNA, 246 bp, Homo sapiens
  misc_feature 179: n = A,T,C or G
atcctgccttagctaaggctccctccagctgcagagggtgtttttgttagactcacacactgcgtgaaactgctcagaatagagccatgatctcaaccacgaaatgggaacttagattttggagaaactaacgggggcggacttctttcctagcctgagtgttgagcagtgtcatgccntggcgtttcagctcctcgttgtctaggtggtgaaatgacagaactcattcgcttctttgattggtga

SEQ ID NO: 35812 - DNA, 257 bp, Homo sapiens
acaacttctggtgtcagaactgtccgaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatg

SEQ ID NO: 35813 - DNA, 108 bp, Homo sapiens
  misc_feature 22: n = A,T,C or G
agaacaacctgcacaacctggntttttttataaataaaacactgagccatttgctgcatttctttttatactaaatatgtgactgacaataaaaacaattttgacttt

SEQ ID NO: 35814 - DNA, 199 bp, Homo sapiens
  misc_feature 20, 134: n = A,T,C or G
agtttttgaataatgcttgncgaatccaaaaaaaacaaaatgccaagaggtttaaaagacggtggatggtcagaaagatgaaaactaagaagtaaatcaatgctaaatgaagaatctgtactttgtatgtatangaatttatctaataaatcattcataggatcattttaaaggatcattataaaaatcataaacctga

SEQ ID NO: 35815 - DNA, 100 bp, Homo sapiens
actgttttaaggcacttctatttatttgcccattcacaactgtataataatacttgtttttcacgtccttttatttatttatttattttgagacggagtc

SEQ ID NO: 35816 - DNA, 101 bp, Homo sapiens
  misc_feature 11, 62, 71, 82: n = A,T,C or G
agctctgcatnaccacacacagccagagcctgtgaggagctgccctcttccccatgtgactngcaaagagnctcaggcaagnaaaccagggctgcaaactg

SEQ ID NO: 35817 - DNA, 262 bp, Homo sapiens
gaaaagtgaaatatttaaaatatggaaaggaaaaagttcacacctacttaaaattctagatcaagttaaataatctttcttaagtgaagcaaaataaaatatatttcagacagacaaagctgaggaatttcaatgccagagacttgccctgcaagagatgttaaaagaggccctatagggagaaaaatatggtgccgaatatataatgcagtagctgggatctccatcaataaagggagagtgttagagatggaataaagat

SEQ ID NO: 35818 - DNA, 274 bp, Homo sapiens
  misc_feature 263: n = A,T,C or G
tgaaaggttggcacccctaacccccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcanaaatagtcttg

SEQ ID NO: 35819 - DNA, 296 bp, Homo sapiens
  misc_feature 24: n = A,T,C or G
aatccctgtaaggaggacgatgancttgaatttgcactgactttcccagctgtttcttactctgatcaacttgggggtaggacccattgagctgcatcacatcattccaaagccaaaacacaacagcaggacaagaagattttcaaggcagtctctaaagcagaggagaaactgttgagtgaacctagaagtaaaggagatctggcttgctggactccatttgaactttgagtacaacagagacatgagcccttcgggacacatgcctgaggtagtgacagtccaactttggaaga

SEQ ID NO: 35820 - DNA, 184 bp, Homo sapiens
  misc_feature 21: n = A,T,C or G
gacgacttcggtaactacagngacgacaactttggtaactacggtcaggaaacagaggaagattttgccaatcagctgaaacaatacaggcaagctaaagaaacctcaaatactgctttagggtcatcattttctaaagaatcaggaaaaaaacagagaatgaaaggagttcagcaaggtattg

SEQ ID NO: 35821 - DNA, 110 bp, Homo sapiens
agagagaaagcagaagatagggcagctcgagaacgtataaaacagcagattgcattgactaacaaaaaaacttgaagaaaggagagaagagaaaagaaaagaggaagaac

SEQ ID NO: 35822 - DNA, 337 bp, Homo sapiens
  misc_feature 25, 267, 297, 327: n = A,T,C or G
ctgaaggccaagaatatggcagaanatagaaatcatttgaaactggtaaacatttcaacttgaatatatatgtccaaaaaattaaaattcaaaaatgttatatgcactcacatattcagcactctaacttaagctacagcacacttctgagatctgatagtaacaatattgtaaagcttaattatatttttatggcccatgccatctgggcatttgttctgcttacaatagtaatagaatttaaaaaaaaaaaatttagtttgcagngcaattgtcttaccacaaatgcatcaaggnaaattatctcttattattggaaaatcctgnggttgggggg

SEQ ID NO: 35823 - DNA, 258 bp, Homo sapiens
  misc_feature 178: n = A,T,C or G
gcatacatttcctgctttcaccacttaaccactgaattgctattttttccttttggccagatagctaggtttctggttcccccacagtaggtgttttcacataagattagggtccttttggaaagaatagttgcagtgtttataggatagttgtggtaagaatctagtttattttgcntttggctaattggtctgtgctgcatggttatatactcctggattatagattaaaagtctctgtagacatctctgtgaaga

SEQ ID NO: 35824 - DNA, 217 bp, Homo sapiens
  misc_feature 25: n = A,T,C or G
gtgggttaaagggatctgcagaccnggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccaga

SEQ ID NO: 35825 - DNA, 243 bp, Homo sapiens
  misc_feature 3, 5: n = A,T,C or G
atncntaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccaga

SEQ ID NO: 35826 - DNA, 209 bp, Homo sapiens
ctagatgcaaagcaggattcaaacgaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctg

SEQ ID NO: 35827 - DNA, 277 bp, Homo sapiens
  misc_feature 15, 172, 173: n = A,T,C or G
ctttgtgattaaatnctgccctaaaatgtcacaaaacaggaaccagcattctaattagatttactatatcaagatatggttcaaataggactactagagttcattgaacactaaaactatgaaacaattactttttatattaaaaagaccatggatttaacttatgaaaatnnaaatgcaggatagtaatttttgtttacttttttaaccaaactgaatttttgaaagactattgcaggtgtttaaaaagaaagaaaagttgttttatctaatactg

SEQ ID NO: 35828 - DNA, 167 bp, Homo sapiens
gctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtg

SEQ ID NO: 35829 - DNA, 131 bp, Homo sapiens
  misc_feature 126, 128: n = A,T,C or G
gagaccagcctggtcaatatggtgaaaccctgtctctactaaaaatacaaaaattagctgggcgtggtggtgcgtgcctgtaatcccagctactcaggaggctaaggaaggagagttgcttgaacncngaa

SEQ ID NO: 35830 - DNA, 242 bp, Homo sapiens
  misc_feature 175, 176, 177: n = A,T,C or G
gcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggctnnngtaacagtgtgatctttactgatgcactcatgacaagtacccaatgtattttagctattttagta

SEQ ID NO: 35831 - DNA, 109 bp, Homo sapiens
  misc_feature 2: n = A,T,C or G
cncatgtagattgaaaaggaagcctaaaactatttctgtttgcggatgacatgattttgtgtgtagaaaattctaagggacacacacacactcatacacaactattagg

SEQ ID NO: 35832 - DNA, 228 bp, Homo sapiens
  misc_feature 24, 27, 217: n = A,T,C or G
cagtgtcatttatagaatccctanccntatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctcctggagnccttaaaacac

SEQ ID NO: 35833 - DNA, 254 bp, Homo sapiens
  misc_feature 124, 150: n = A,T,C or G
ccaaggctgcaccttggacgccatgaaggttttctgcaacatggagactggcgagacttgcgtctaccccaatccagcaaacgttcccaagaagaactggtggagcagcaagagcaaggagaanaaacacatctggtttggagaaaccanggggggcggcttccatttcagctatggagatgacaatctggctcccaacactgccaacgtccagatgaccttcctacgcctgctgtccacggaaggctcccaga

SEQ ID NO: 35834 - DNA, 121 bp, Homo sapiens
taggaatgcctaaagataatttccttccctaaagccactaaatccaaatacaaagcaacacaaaaacaaataaaagaaacagcagagagtttgttttaacaagcatgtctgaaggatggtt

SEQ ID NO: 35835 - DNA, 292 bp, Homo sapiens
ctctgggatctcacaacgggcaccaccacgaggcgatttgtgggccataccaaggatgtgctgagtgtggccttctcctctgacaaccggctgattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaaga

SEQ ID NO: 35836 - DNA, 130 bp, Homo sapiens
  misc_feature 93, 103: n = A,T,C or G
tgtggcacagcctttcccttaagctatatagcaaatgggacacagcactttgtttctatgcctggattcccatacaatattattttctaagtntgttcatgtnaacagcctgagccttatttcaagcagt

SEQ ID NO: 35837 - DNA, 119 bp, Homo sapiens
tcttttttgttaggctcaattcctaccatccaggaactttcaacaaggggccatgtttagtaataagtaaagtaggaagagcccttaacttggaaatgtctgtctcccaaaaaagtcac

SEQ ID NO: 35838 - DNA, 331 bp, Homo sapiens
  misc_feature 181: n = A,T,C or G
gagcaaggaagacattgaacgtccggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagatnctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggagga

SEQ ID NO: 35839 - DNA, 289 bp, Homo sapiens
  misc_feature 21, 25: n = A,T,C or G
gcgagagctgcgaagggccangccncgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctgga

SEQ ID NO: 35840 - DNA, 126 bp, Homo sapiens
  misc_feature 123: n = A,T,C or G
gttttgttttgttcataatacaaaggtgctaattaatagtatttcagatacttgaagaatgttgatggtgctagaagaatttgagaagaaatactcctgtattgagttgtatcgtgtggtgtnttt

SEQ ID NO: 35841 - DNA, 226 bp, Homo sapiens
  misc_feature 2, 175: n = A,T,C or G
tngtagcccagggaagccaaaacatgggagaagtgtctagacccttcaatggttgctccctgtttcccctcccccagccccctggtgacttctggtcaactttctgtcactgtgaattggcctattctaggtattttgcgtaagtggagtcatagaagtgtctttttgtgactgnggggcttcacctggtatgtccaagttcatcagttctgtggcatgtgtgaga

SEQ ID NO: 35842 - DNA, 251 bp, Homo sapiens
  misc_feature 24, 147: n = A,T,C or G
cagactgcaaaataaaatctcggngttctacttatttattgtcttcctgtaagaccttcgggtcaaggcagaggcaggaaactaactggtgtgagtcaaatgccccctgagtgactgcccccagcccaggccagaagacctcccttnaggggccgggcgcaggaactgtgtgtgtcctacacaatggtgctattctgtgtcaaacacctctgtattttttaaaacatcaattgatattaaaaatgaaaaga

SEQ ID NO: 35843 - DNA, 338 bp, Homo sapiens
  misc_feature 24, 179, 274: n = A,T,C or G
tggaactactgcatgtttaaaacnccaacaaaaaaagagagaaagagctatactaagaacatatattattcagatcagtttctgccaatttcagtggtttattgttcacaaaaaaatcttcaaaacaagtattgactttcacaaaatttaaatcataaacaggcaaaccaaacagcacncgggagctatagttgttatgtgattgttttttaattgctgtaggatcctgttctttcagcaggtgaaaaataaaacgcagttcaaatttcatggntttaattttcaactcagaagcactcaaaaatgcaaaatgtgataatgggcacttgtttaaaaga

SEQ ID NO: 35844 - DNA, 110 bp, Homo sapiens
atttgtttctactttgatatgactgtttttcggacagtttatttgttgagagtgtgaccaaaagttacatgtttgcacctttctagttgaaaataaagtgtatatttttt

SEQ ID NO: 35845 - DNA, 285 bp, Homo sapiens
  misc_feature 24, 25: n = A,T,C or G
tccttgagtgaaaccgtcagaacnngtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaaga

SEQ ID NO: 35846 - DNA, 255 bp, Homo sapiens
  misc_feature 25, 151, 180: n = A,T,C or G
actgagcggacaaacggaagtgccngttacggtctgagacatcaccgccaagctgggcatcggggagatggccgagactgaccccaagaccgtgcaggacctcacctcggtggtgcagacactcctgcagcagatgcaagataaatttcanaccatgtctgaccagatcattgggagaantgatgatatgagtagtcgcattgatgatctggaaaagaatatcgcggacctcatgacacaggctggggtggaaga

SEQ ID NO: 35847 - DNA, 174 bp, Homo sapiens
  misc_feature 151, 153, 156: n = A,T,C or G
tctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtngnggnagtcctcttccaaagaga

SEQ ID NO: 35848 - DNA, 286 bp, Homo sapiens
  misc_feature 23, 177: n = A,T,C or G
tcaaaagctgcttcttagaaagncgcagtggctcatgtctataatcccagcactttgggaggccgaggtgggtggatcacttgagtgcaggagttcgagaccagcctggacaacgtggtgaaaccccatctctacaaaaaaatcgttaaaaattagctgggcatggtagtgtgcgcntgtagtcccagctacttgggaggctgagatgggaggattgcttgggcccaggagatcaaggtgacagtgaaccttggtcatgcgactgtactccagcatgggcaataga

SEQ ID NO: 35849 - DNA, 121 bp, Homo sapiens
tgacttctgaataatgcctctatgaacattcatatgcatttgtgtggacatgtgctttcagttttctcagaaatatacctaggagtggaattgagctgggttatatggtacctctgtgttt

SEQ ID NO: 35850 - DNA, 163 bp, Homo sapiens
  misc_feature 30, 63, 142: n = A,T,C or G
tcactccaggactgccagaggaagcaatcnccaaaatgaagactgctttaattttgctcagcnttttgggaatggcctgtgctttctcaatgaaaaatttgcgtcggggagtcaaaatagaggattctgaagaaaatggggnctttaagtgcaggccacgatg

SEQ ID NO: 35851 - DNA, 153 bp, Homo sapiens
gcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcaggggggg

SEQ ID NO: 35852 - DNA, 115 bp, Homo sapiens
  misc_feature 17, 22: n = A,T,C or G
accaatgtaatcctatngcacngctcaacagaatcagaataagaagaacttccaagtacaatttgaaaataaaagtatctttcaagaatttgcactgtactgcattatttgattt

SEQ ID NO: 35853 - DNA, 167 bp, Homo sapiens
  misc_feature 19: n = A,T,C or G
ctactaaaaatacaaaatnagcccggcgtcgtggcgcatgcctgtcatcccagctactcaggaggctgaggcaggagaatcacttgaacccgggaggctgaggttgtggtgagccgagatcgcgccattgtactccagcctgggctacaagagtgaaactccatccc

SEQ ID NO: 35854 - DNA, 200 bp, Homo sapiens
  misc_feature 2, 8, 159, 160: n = A,T,C or G
gngaaccngaattattatcaggcaactcctacagatttctgtttgttttcttgtttgccataactcataggagattacattctgacttctaaggagaatgatgtgaagttcccacagagaaactcctcatataggtaggggccagaagagaacaaagtnntcccatgtcagtaaaaaaaataaaggagatatatcccatc

SEQ ID NO: 35855 - DNA, 118 bp, Homo sapiens
agcagctggcaacctcaagaaggccctgctcatccagggctccaatgacgtggagatccgggcagagggcaatagcaggttcacgtacactgccctgaaggatggctgcacgaaacat

SEQ ID NO: 35856 - DNA, 158 bp, Homo sapiens
  misc_feature 152, 158: n = A,T,C or G
gaacaatcaaattcaattcgggaagaatatagaggtggtaataattggtaaaagtctgcaggtttttttttaaccaaaggaaactggtttgagaaaattgtgaaatcagcattgaaatttgttacctactccaatcaagatttgcaaaaaangggggn

SEQ ID NO: 35857 - DNA, 174 bp, Homo sapiens
  misc_feature 124: n = A,T,C or G
atttgttttgtataggaattatttgtgccacctgctgtggactgttttctttgcctagtgactagtgacctgtgttgtctaaacatgagtttcagccctttggttttgtttaataccatgtcanatgcaaacttcaattctccccatttagctttattaaactgacgttctctt

SEQ ID NO: 35858 - DNA, 300 bp, Homo sapiens
  misc_feature 178, 179: n = A,T,C or G
cagccaagttctcagtaatagtccgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcnnctcttttcttcatactgcaatgttgctagatacatgatcagacaccagagggttgggcattcttgcaataccttaacagtgctgaaatctgcagcatggtgctaaggaagttaaagtttga

SEQ ID NO: 35859 - DNA, 147 bp, Homo sapiens
  misc_feature 25: n = A,T,C or G
tgtggactctgcctgcctacctggnctgggaagatgttctaccatatctccctagagcacgaaatcctgctgcacccgcgctacttcggccccaacttgctcaacacggtgaagcagaagctcttcaccgaggtggaggggacctgc

SEQ ID NO: 35860 - DNA, 175 bp, Homo sapiens
  misc_feature 154: n = A,T,C or G
tgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaagggnattcgagacgccgtcacctat

SEQ ID NO: 35861 - DNA, 239 bp, Homo sapiens
  misc_feature 3, 6, 157, 158, 161: n = A,T,C or G
aanccncagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagnnggngaaattgatgaagaaccagtcagtaaagcaaaacagagtcggagtgaaaagaaggcacggaaggctatgtccaaactg

SEQ ID NO: 35862 - DNA, 104 bp, Homo sapiens
agaacgtgcacatacagaggagagagctaatttagaaaacaaaaccacagaatttgatgacgtgtgtgtgtgtgtgtgtgtgtgtgtgtgtgtgtgtgtgtgtg

SEQ ID NO: 35863 - DNA, 100 bp, Homo sapiens
  misc_feature 21, 34, 75: n = A,T,C or G
tagcccagcgctgaaatattnatatggtcctcanctgcccaaggaggaggctcctgatgatcccaggtctactcnactctccatacaccacacaggcctc

SEQ ID NO: 35864 - DNA, 130 bp, Homo sapiens
  misc_feature 24: n = A,T,C or G
gacctcctggccaacaaaaacccnccctgtctgtaccaaaaatacaaaaattaattgggcatgggggtggacacctgtaatcccagctactagggaggctgaggcaggagaattgcttgaacctgggagg

SEQ ID NO: 35865 - DNA, 124 bp, Homo sapiens
atggtgaaaccctgtttctactaaaaatacaaaaattagccgagcgcggtggcaggcgactgtaatcccagttactcagtagctgaggcaggagaatcgcttgaacccgggaggcggaggttgc

SEQ ID NO: 35866 - DNA, 203 bp, Homo sapiens
ataaaagatacagtaaaaatcctgtataaaagataaacaatggtacacctatagggcatttgccatgaacagagcttgcaggactggaagttgctctggatgggtgagtgactgagtggtgagtgaatgcgaaggcctagtacattattgtacactggtgtaggctttatagacactgtacacttaggctacactaaatttgt

SEQ ID NO: 35867 - DNA, 127 bp, Homo sapiens
  misc_feature 39: n = A,T,C or G
gggaagaaactagtctgtggggaccattataagagaatnacattatatattacacagtatatggatattggaatgtatcacttgtggggggttctcttcattagcaaaacagtcatgtctgtctgta

SEQ ID NO: 35868 - DNA, 123 bp, Homo sapiens
agatgtgaaattttaaaggggctgaaagttctaagaaaggatgtgggtggggaagcaacgaggtggtaaacagaggctaatgatgagagggcctaagtgtggaatttgggggtatattatagg

SEQ ID NO: 35869 - DNA, 304 bp, Homo sapiens
  misc_feature 231: n = A,T,C or G
attgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccaganccctggaacaaactgggtcccaatgatcaatacaagttctactcagtgaatgtggattacagcaagctgaaga

SEQ ID NO: 35870 - DNA, 127 bp, Homo sapiens
cgtggtggctcacgcttataatcccagcactttgggaggctgaggtggaaggatcacttgagcccaggtgtttgagactagcctgggcaacatagagagactccatttctacaaaaaaaacaaaact

SEQ ID NO: 35871 - DNA, 283 bp, Homo sapiens
  misc_feature 1: n = A,T,C or G
ncttttatcctaatatcggtagcatataatgcccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctt

SEQ ID NO: 35872 - DNA, 166 bp, Homo sapiens
  misc_feature 145: n = A,T,C or G
ggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcaganccaggatataactagaaaaag

SEQ ID NO: 35873 - DNA, 387 bp, Homo sapiens
  misc_feature 30: n = A,T,C or G
aggatgtggacattgagccttatgtaagcnaaatgttaggtaagcttccaacgcgttttatctttaccagtcaaagagggtgttttattttatctatctatgtgtttattgaaatgaggtcttgctttgttgcccaggatggagtgcagtggctatgcacaggtgcggtcatagcacactatagccttgaactcctgggctcaagcgatcctctcacctcagcctccggagtagctgggactgtaggtaggcacagccacctcacccagtccttgtttttatttttaaatagtctaaaatgctgggtagaaccaatgaattaagttatctcaggagtagtgaacttttatcattgaaagtgtcagacgtttcaatctaccttactct

SEQ ID NO: 35874 - DNA, 450 bp, Homo sapiens
  misc_feature 7, 22, 30: n = A,T,C or G
tcggccntttatggcccgggantcctgganctgactgatacctacagtgccctcgcccgccctgggcccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaactttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagagtc

SEQ ID NO: 35875 - DNA, 241 bp, Homo sapiens
  misc_feature 24: n = A,T,C or G
tccggccaatttatggcccgggancgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgaggaaaaaagcagtctaataaaatcctagacag

SEQ ID NO: 35876 - DNA, 437 bp, Homo sapiens
  misc_feature 7: n = A,T,C or G
aaggaancaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctaga

SEQ ID NO: 35877 - DNA, 278 bp, Homo sapiens
  misc_feature 10, 18: n = A,T,C or G
cctgggaatntccggccntttatggcccggggctcacaagccccctacaccttctgggctgaagaatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttac

SEQ ID NO: 35878 - DNA, 298 bp, Homo sapiens
agaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaacttt

SEQ ID NO: 35879 - DNA, 465 bp, Homo sapiens
  misc_feature 3, 4, 28: n = A,T,C or G
aanntccggccaattatggcccgggggntaatttttgtatttttagtagagtcgggggtttcactatgttggccaggctggtctcaaactcctgaccttgtggtccacccgcctcagcctcccaaagtgctgggattacagtcatgagccaccatgcccagcctaccatatcagtttttaataacttgaactgaaattattggcttggtaatatttgggcaggccattaattctcattagaaaattacttaatatttcaaaaaattgaataaaactggtaatctttgtggaggcccattttgcaagtggaaacctgtatttatacattagtttgtctttaactatttgttaacagattttaacagttcaaatgaaagatgttaacgagatgcagtttgagtctgggatactcagaatagatccagaacctttattcagggacactggttgagttggtacagatgc

SEQ ID NO: 35880 - DNA, 434 bp, Homo sapiens
  misc_feature 20: n = A,T,C or G
ggtgccctggttcgccaagnagtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgagcccctcatcttcatttattatattatcaaaactgagagggataggaaagaaaaacttatccaggaaggaaaattggatcgaacatttcacctctcatattaagtctggcaatgatgactatatgtat

SEQ ID NO: 35881 - DNA, 229 bp, Homo sapiens
  misc_feature 2, 4: n = A,T,C or G
antntggcccgggggatccggcggctccatccctggccctcgctgtccaccttccgcagatgtggatcagcaagcaggagtatgacgagtccggcccctccatcgtccaccgcaaatgcttctaggcggactatgacttagttgcgttacacccttccttgacaaaacctaacttgcgcagaaaacaagatgagattggcatggctttatttgtttttttgttttgttt

SEQ ID NO: 35882 - DNA, 380 bp, Homo sapiens
  misc_feature 19, 20, 48: n = A,T,C or G
tcccgggaatctccggccnnttatggcccgggggatttcatgggatgnaccagaatgaacatcgtggctcatggctgtcagtagtgaaaaatagctggaaatcagacaaacaactttattgctgagattgtttccgggctaaaagttcttccaacagctgtttgttttggccattaacatgtccattctttttattttttctgagctgggggaaatacaattttctttaaaaagagaatgcaggctggctatttctgaaatcaggaagaacccctgtccttccactgttgtggtcttttggctgctctgacatttggactgaagggcttttccttttgattttttcctctttttcactctcaaagttcagactcagactg

SEQ ID NO: 35883 - DNA, 435 bp, Homo sapiens
  misc_feature 4, 14, 19, 29, 58: n = A,T,C or G
aatnacttttttcnagaantaaaaaatantggacccctttgtgtttacctaactaganaaagccagatataatttttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgc

SEQ ID NO: 35884 - DNA, 500 bp, Homo sapiens
  misc_feature 13, 20, 30, 47, 51, 52, 61: n = A,T,C or G
tgggcccggggtntggggancttgtttttncattctccttttttccnttcnnttgaagaanaaattcttggctgtcccaaggattcttcatgtattatttgcaaaatttaatatatttgttcaccttgagtcttaagagtagatcaggcccaaggcaggtggatcaccctgaggtcagaagttcaagaccagccctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaagtaggtcaattcgtaacagtttattttggacacaccctgaagcttttgttttgaattaagaaatgagtttcaggaattgacaaaccatttgttaaccagct

SEQ ID NO: 35885 - DNA, 491 bp, Homo sapiens
  misc_feature 8: n = A,T,C or G
tccggccncttatggcccggggtatcaggtggaagtttctgcccttatggagtttacagtcttataatagagccagagaacttagcagacagtttggagactgtaagaattgctgtgataggaggcggtagctcccaaagccaagagctgcaccagattcactactagggctgagggtcacaaatggcttctaaaggaagtgatagttttgccatttggttcttgaactccttgatggggcatacatgtgtgactgcacatacacacacaaaatattttttaaattaaattttaaattgtaaaatacacataacataaaatttactatcttaattattttaaaatgtatccttcagtgttgttaagtatatttttattatttggcaaccaatcttcagaactttttcatcttgtaaaactgagactctgtagcattaaagaacagttccccattcccttctaccccctctcccctaatcccctggcaagca

SEQ ID NO: 35886 - DNA, 428 bp, Homo sapiens
  misc_feature 30, 32: n = A,T,C or G
gcagaatcctttgaagcaaaggaagccagnanagcacgagggaatctaggctttcagagaacagtaatttgattcagcccaattcatttatttatttaataaatatttgttaaatgcctactgtgtgcctggctggagattgagcaatgatagctccaacctcactggccttctgcgtgttcctcaaacgtaggtaacctattccactgcagagcttttatatttgtggttccctctgcctggggtaccgttccctctgatcttcccaaaactagctccttcctcattcagtcttaggctcaaatgatagtcaaaaatgcctccctgaccactgtaactaaagtagtccctgtcagtaggccagtaactctctcatatcactctgtttatctgtgtatttttttaccttgtaaaatcatttctgtttg

SEQ ID NO: 35887 - DNA, 351 bp, Homo sapiens
aagttacctcaagagttctccctgaccttggtgatgccgtgggcactcacagaagcctcctctgtgctgcagggaggctgtgtcttactcatgcagggtggtggaggggcgcctcttagcagaagatgatgaaaggctgtcccctctcaggaaggagaaggtcctcgtctgttccaaggcaaagaactggacaagaaggaggaggttcattcagtacattgagtctgatcctccctgctgtagctggagcacggtccctgaagctggctgaagtgctaaggcaggggctagcaaactgtggccgaatcccacctgctgcctgtttgtataaataaagttttattgggacac

SEQ ID NO: 35888 - DNA, 467 bp, Homo sapiens
  misc_feature 15, 16: n = A,T,C or G
atggcccggggaaanntgataaaattaacctaacacatgtacctatttaaaagtatagtgataattaccccccactataaatcatggtatcattataaatcatgattaccattataaatcagatttcagttaaggcttgatatgaagaagtgtttcaggccagaccttctcaaactttaacgttctaatgttcatacaaattacaaatcatctgcatatcatgttacaatgaagattatgactcagtagtctaagttggacacaaattcataggtgatgctaatactgctggttcatggaccatgttttgagagccaagattctggacaacccaatggtttatgacaacagaggagactccagagcggggagttgatgtgtagaagtcttggggcaagtgactagcaaggaaggaggaaagcttgggtcacacaggcatcagtggggggcagggtgattaaccattc

SEQ ID NO: 35889 - DNA, 305 bp, Homo sapiens
  misc_feature 4, 28, 37, 38, 42, 106: n = A,T,C or G
ctangggcccggggtgggcttgggccgnagtggctcnncgcnctgtgatcccaacactttggtaagccaagatgggcagatcgcttgggcctcaggagtttgaganccagccctggacaaccagggcagagcccctgtctctacaaggaagtgcaagaattaactgggcgtggtggctcatatttatagtccaagctacttgggggactgaagtgggaggattggttgagcccaggaggttgaggctgcaatgagtggagatcatgccactgcactccagcccggatgacaaagtgagaccctgt

SEQ ID NO: 35890 - DNA, 394 bp, Homo sapiens
  misc_feature 8, 9, 24, 39: n = A,T,C or G
tggccgcnntgccctgtaatcccnaaaatgcctgggatntaccaggagtgagcccacccatgccccggctggcagttgcatggaagaagaaccaccctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaacctttttttt

SEQ ID NO: 35891 - DNA, 362 bp, Homo sapiens
gttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctt

SEQ ID NO: 35892 - DNA, 147 bp, Homo sapiens
  misc_feature 4, 7, 8: n = A,T,C or G
aaanacnncccccggcctccgctggccgtggagcccgggccgtggaatgcgagtgcctagtgggccacttttggtaagcagaactggcgctgcgggatgaaccgaacgccgggttaaggcgcccgatgccgacgctcatcagacccc

SEQ ID NO: 35893 - DNA, 161 bp, Homo sapiens
  misc_feature 2, 8, 29: n = A,T,C or G
anactacnaatgcttcctttccctgtatntttcctcttgtctggctgcccccctttttcccgcccccagattgataagtaatgaaagtgccctgcagtgagggtcaaaggagagtcaacatatgtgattgttccataataaacttctggtgtgatactttc

SEQ ID NO: 35894 - DNA, 308 bp, Homo sapiens
  misc_feature 7: n = A,T,C or G
tcggccntttatggcccgggggcagatttacctttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcag

SEQ ID NO: 35895 - DNA, 479 bp, Homo sapiens
  misc_feature 9, 14, 46, 53: n = A,T,C or G
gttaacctntaaangttaatgggctaattgcccccaattaaaaganaccaganctggcaaattggataaagggtcaagacccattggtgtgctgtattcaggagacccatctcatgtgcaaagacacacataggctcaaaataaagggatggaggaatatttaccaagtaaatggaaagcaaaaaaaagcaggggttgcaattctagtctctgataaaacaaactttaaaccaacaaagatcaaaagagacaaagaagggcattacataatggtaagggatcatgcaacaagaagagctaactatcctaaatatatatgctcccagtacaggagcacccagattcataaagcaagttcttagagacctacaaagagacttaggctcccatacaataatagtggggagactttaataccccattgtcaatattagacagatcgagacagaaaattaaaaagaatattcaggacttgaact

SEQ ID NO: 35896 - DNA, 344 bp, Homo sapiens
  misc_feature 16: n = A,T,C or G
ggagacgacaaacagnaatatggaatgatcagaattactcttatgacccagaccaagaacatcagcattacctacgaatttattggaaattcagattctcctgtttcaccccaggcctgttaaatcagaaactttaaaagcgagcccagcattctgtggtttaacagatccttcaggtgattctgacacctgctgaattttgagaaccactggtctagaggcaggcaggtcttgctcccctaggagttaagtttgatgtatcttctggtaatactgagaaatgagctgggagatggttccaaaatcagattatcctccccaggattaacaagactcatacttat

SEQ ID NO: 35897 - DNA, 370 bp, Homo sapiens
  misc_feature 3, 6, 36, 38, 48, 49: n = A,T,C or G
ggnganataaaggcaacagccagcctgacccctgcntngttagagttnnggtgcaatccttaaagagtagtagaattgtatttattgggttagaacagtttcctgcaataggtaatatactgttttacaaagaacacattgtcaaatgatgtttttatttaaaatatgcatagacacactttttaatacttagtaagaagtcttgaacaatagatactaaagcatataggttatcagcttcaggtaggggatggtttttcctcctgctctttccatatctttatgttctcatataaacatatattagttacgtcaaaacattttaaagtttaaaataccgactggttttatcagaacatcagaggtcact

SEQ ID NO: 35898 - DNA, 148 bp, Homo sapiens
  misc_feature 7, 24, 37, 58, 144: n = A,T,C or G
ttggganggagtgccttgccctcnagccagccattantatttctaaaaagtgtacccnagtgccagaaaaagattagccattgcccacctattgccaaggatgaccattgccaaaatttgggtggaaagccatttcccattatntatt

SEQ ID NO: 35899 - DNA, 229 bp, Homo sapiens
aggaatgttcttactaagacaataaagtgaacaagcaccttttagatatacactaagagttcataaatgactgatttcttgcttaacattgttagccagaataatttaattatacaattctctaaactctcactttacctgtaattttcttggtactatcactctctccttctgacttgtaaacatattaaaggctactaatttatttgtgtctctctcagtgcctagt

SEQ ID NO: 35900 - DNA, 500 bp, Homo sapiens
  misc_feature 13, 14, 37, 38: n = A,T,C or G
tactccggggaanntccggccatttatggcccggganntgtgaaaaagttgcccgggtgcagcgcccttttccttctaccatgggaaatgcaggctgggccccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaactt

SEQ ID NO: 35901 - DNA, 136 bp, Homo sapiens
  misc_feature 8, 9, 33: n = A,T,C or G
tccggccnntttattgggccccgggcctgttcnttggtgccttttaccaaaaatagtagtcagtgggttttttttctgacttgaaaaggcatctatgcctcattaataattattcaggaaagcaataaccaacaac

SEQ ID NO: 35902 - DNA, 396 bp, Homo sapiens
  misc_feature 9, 14, 34, 44, 45, 142: n = A,T,C or G
cgggggtcntgaantatgggccggccctccagcnagccgccganngtgcctgcggcgcctgcgtagaaagtattcaatccagcccggttgcttttgtgagaagaattcccttggacctgcggcgtcgagtcagctgaaagancactttgcacagttcggccatgtcagaaggtgcattttacccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactga

SEQ ID NO: 35903 - DNA, 430 bp, Homo sapiens
aggaggagggacatttgttgttttttaatctagaactttacaaatctcaaagccaaagaactactaaatattatccctactaattgaggaattgaggaaatgacgatgctttccaaaatactcttaattatgaaaggagttttctgttaccagaaagggcagacgttgtagaccatctgcagcttccttcctggtaccttagaaaagctgttatatcttggccgagcacggtggctcacgcctgtaatcccagcactttgggaggctgagccagatggattgcgtgagcccgggaatttgagacctgcctgggaaacatggtgaaacctcatctctactaaaaacacaaaaattagctaggtgtggtggcatgcacctgtaatcccagctactcaggaggctgaggcaggagaattgcttgaacctggga

SEQ ID NO: 35904 - DNA, 469 bp, Homo sapiens
agcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctccgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactcc

SEQ ID NO: 35905 - DNA, 415 bp, Homo sapiens
tatggccggggccccccgcaatgcctgattcttttatctgcttctgtattcaatctgttgtgatatgatgggtagcctctgaaacactccactgtatacttgtgaaagaatgaatgtgaaaaaggaaaatagatttgtagtattattatgcaaattgttttgacctcagagaccacttggaaatgttttagggaacccccagaggaccttggatcatgctttgagaaccgcggctctagatatgttactatttcagtagcatctaagtacatgtggctgctgagcacttgtaatgtggctagtgcaaatgagagacaggacttccagctatatgtaatttaacaaactcaaatttaaaaactggaacctcataaaatgttttgttgttgttgttaaacatgaccttatagttttg

SEQ ID NO: 35906 - DNA, 208 bp, Homo sapiens
  misc_feature 17, 18, 32: n = A,T,C or G
atgggcccgttagaaannagtttgtttaaganctgactccatccctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttcac

SEQ ID NO: 35907 - DNA, 369 bp, Homo sapiens
  misc_feature 12, 13: n = A,T,C or G
atggcccggganngaagccctgtgatgacctacagaactttgcgaacgcctacgcccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttccga

SEQ ID NO: 35908 - DNA, 497 bp, Homo sapiens
  misc_feature 12, 21: n = A,T,C or G
cgggataggagngcccgagcnggaattcggtgtggacattagggccggtctgcttcttgtaaaaaccctgaaccccagaaacaacacaatccgttgcaaaccccaaaggaccccaagtacctttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtggtgtgtcctacacaatggtgctattctgtgtcaaacacctctgtattttttaaaacatcaattgatattaaaaatgaaaagatt

SEQ ID NO: 35909 - DNA, 120 bp, Homo sapiens
  misc_feature 4, 12, 13: n = A,T,C or G
aatngccgggannggaaattggtgaatcccaccaaaaaaactgcctctcgctcctcaacccctcccctccatccctggcccccctccctggatgacattaaagaagggttgagcctggat

SEQ ID NO: 35910 - DNA, 478 bp, Homo sapiens
  misc_feature 8, 32, 44, 58, 80: n = A,T,C or G
tccggccntttattggcccggggggaggccgncgccgcccggangaaagatggaaganctacccaggctgcggaggaganctgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacggaatcaacccctgcatacatcacactcaagtcaaagcctgaaaagctgaggaagcaatcccaacagcccagaggaacgtcctaaatatcaatgtaaagaaataagaaatcttaagttgaaaatcataaaaaataactaactgagtgacaattact

SEQ ID NO: 35911 - DNA, 260 bp, Homo sapiens
  misc_feature 13, 25, 32, 54: n = A,T,C or G
aatggcccgggcnagtgggcctgancggaaanattagcctaaagtattttaccntgttttgtaagatctcttggtttagcaaatacattcaaagaaatttttccacccaaacgtgccacaagaattgtgttttcatttctcctgtgcaagtacagaatggagagaaagtaggcaatcagggagagatgcaaagagtctagcaaattatttctagcataatcacacatctaacttcagactcagccttgttttataattcc

SEQ ID NO: 35912 - DNA, 450 bp, Homo sapiens
gctttttttttgaggaagacgcggtcgtaagggctgaggatttttggtccgcacgctcctgctcctgactcaccgctgttcgctctcgccgaggaacaagtcggtcaggaagcccgcgcgcagcagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagc

SEQ ID NO: 35913 - DNA, 155 bp, Homo sapiens
  misc_feature 22, 36, 37, 155: n = A,T,C or G
gtcccccgggaatctccggccnttatggcccggggnncgatgatgatgaagaggatgatgatgaagatgatgatgatgatgattttgatgatgaggaagctgaagaaaaagcgccagtgaagaaatctatacgagatactccagccaaaaatgcn

SEQ ID NO: 35914 - DNA, 314 bp, Homo sapiens
  misc_feature 13, 19: n = A,T,C or G
atggcccgggccncaaaangtagggttataataatgttaaccatggacatgatcttctttataattctactttgagtgctgtctccatgtttgatgtatctgagcaggctgctccacaggtagctctaggagggctggcaacttagaggtggggagtagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgac

SEQ ID NO: 35915 - DNA, 108 bp, Homo sapiens
atttctagtttctatatagtgcaatagagcatagattctataaattcttacttgtctaagacaagtaaatctgtgttaaacaagtagtaataaaagttaattcaatct

SEQ ID NO: 35916 - DNA, 122 bp, Homo sapiens
  misc_feature 15, 25: n = A,T,C or G
cctccccccgggaanctccggcccnttatggcccggggaggaaggaaattgtggggatttgaaatattctctttatgttgtttctcttctgagtcatggtaaaacaataaattatcatctct

SEQ ID NO: 35917 - DNA, 500 bp, Homo sapiens
  misc_feature 3, 9: n = A,T,C or G
aanggtgcnagcccaaggaggccaggccccgcccatgtgtccacctgtatacctgtctcctagctcacaggaatgatactgatccactccttgtgctgctctttgtaaagtgatttcacatccattctctggtaatcatcatcacattccctgtgatgaggaattagcaccaattatagaggagaaaactggatctgacatttctcatctcatttgctctatacattaacctcttgcaaaaaatttgtgagtcttgcccaagacccattacaactaattaacggctgaactggtcgtctgatttcaaggccagaattaactttctactgcagctcatggatcaagaggttttctttatttaaacaaacaaacaaaaaatcccttgaccgtagcccttgctataacatttcccactgagttgaggggagaaattggaaagtaaacttaggagctttttatagcttgtcaaaccatgcaagagtggggggaagcttatccat

SEQ ID NO: 35918 - DNA, 498 bp, Homo sapiens
  misc_feature 2, 13, 445: n = A,T,C or G
antggcccgggantctttaggccaacactggtgtcacaaagctcctgtcagggagcctggggtttgggaatgtgctttgtgaacctctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatacaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagangtttgtactttccccaagaggtcctcatcctgagacggtctctacccatgttt

SEQ ID NO: 35919 - DNA, 407 bp, Homo sapiens
  misc_feature 3, 4, 35: n = A,T,C or G
gcnntgcgaggcggaggtagggagcaggttgtggngctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgccctgcggggtcactcccactttgttagtgatgtggttatctcctcagatggccagtttgccctctcaggctcctgggatggaaccctgcgcctctgggatctcacaacgggcaccaccacgaggcgatttgtg

SEQ ID NO: 35920 - DNA, 127 bp, Homo sapiens
  misc_feature 1, 11, 96: n = A,T,C or G
ngccttgctgntgtgccagctgggatatacgctgatggatgaagctcttcagagctatgggcaatatctacatatttgattgtcaagaaacttcgngtggaaatagcttcaaacttacacaaattgc

SEQ ID NO: 35921 - DNA, 428 bp, Homo sapiens
  misc_feature 36: n = A,T,C or G
aacctccggccccttatggcccggggaaaaccaagnaaataatattaaatatgaacatatggagaacagaataatatttttaaaatttttagtttctaagcttatctgaaattttaattttcttttcttatgtaataccagagttattaggaaggtattatctaataacactattttcagtgatattttaagtagttgtcctagaaaaatttctattttttaaaaatgtatatttaaaaatacattaaatgtgtatatacatcaatcatatgtatcgatttctgtttttcttgaattgcaaatgaaatttgtatttttgtgttcctggaataaaataaactcgaatgggtcgtaatatattattcatgctgtaattcaacgtatttgaatactttaagaatgttacatttatagttaacagatactga

SEQ ID NO: 35922 - DNA, 488 bp, Homo sapiens
  misc_feature 10, 19, 27: n = A,T,C or G
tccggggaanttccggccnttatggcncgggggcaaaataaaaagcaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacattgatttgtatcaacatcagatattttatatgtgaatatattaaacatctttaagagattcattttcatgtattaaagaaaaaagaaactat

SEQ ID NO: 35923 - DNA, 216 bp, Homo sapiens
  misc_feature 9: n = A,T,C or G
gatccaagnataaggaaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 35924 - DNA, 211 bp, Homo sapiens
gcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagt

SEQ ID NO: 35925 - DNA, 424 bp, Homo sapiens
gctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgccgtgctctggtctgcggggctactttgcagccaagttcctgctgcgtttgctggactgatgtacttggttgtggggcaaaagtactttgtcggttacctaggagagagaacgcagagcacccctggctacatatttgggaaacgcatcatactcttcctgttcctcatgtccgttgctggcatattcaactat

SEQ ID NO: 35926 - DNA, 354 bp, Homo sapiens
agagtttatttctttaatcctacatttaagttatctgtagacaagggtgatatgggtagcattccacaatgattaaaaaggtttaaataaaaaagcatttgcttttcaccagattaaatattattccacaattttatattttaaataaagtgtaggatctgcagtttctttaaatttcaatgaactagagttttgaaatgcagatcaaagcaaatattccagaaagtataatactgcaggggaaaatgtttgcttgtgtattctagacacttaagaatgtatcatccctgttttccttttcactttattacttatgaattatgtatttccctgggggttttcaatttacaatat

SEQ ID NO: 35927 - DNA, 205 bp, Homo sapiens
cttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatc

SEQ ID NO: 35928 - DNA, 463 bp, Homo sapiens
  misc_feature 2, 19: n = A,T,C or G
tnccccgggaattcggccnttatggcccgggatatgggaggatgtgcaaaggtgatgtgcaaatactatgtcattttatatcagggacttgagtatcctttgttatcctcaggagatcctgaaactagtcctccatggatactgagggctgactgtatattcctatcctcacggaactttcattgtaatgagggaagactgactataaacaaaatatatgtaataggtggtggtaagtaccgtggagaagtaacaaatggggcaaagtgagttatacagctccattcttagaaaccttggagtacttttcttagtttatacctcgtggtggtttccttttgtctcctttattacatgggactctgacatgtgcccatagctagggtggcagtaggatctacccgaaaagcgtcctgctgatacaggaccaaagcatcctgttgttctcgagcctataaaaaga

SEQ ID NO: 35929 - DNA, 160 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 35930 - DNA, 432 bp, Homo sapiens
gtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctg

SEQ ID NO: 35931 - DNA, 276 bp, Homo sapiens
  misc_feature 4: n = A,T,C or G
agancagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacagggtaaacttttgactccccttttgttcatttgtggattaagtggtataatacttaattttggcatttgactcttaagattatgtaaccctagctactttgggatggtcttaga

SEQ ID NO: 35932 - DNA, 413 bp, Homo sapiens
  misc_feature 21: n = A,T,C or G
aaggtggggctaaggaacagnatgagtaataagaggctcttggatttttttaaccaatgcaactgatcctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatg

SEQ ID NO: 35933 - DNA, 474 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatac

SEQ ID NO: 35934 - DNA, 427 bp, Homo sapiens
cattcataattaagtattcctgtatctttgtgtaatctcacctctctatatatctctgtgaccaaattctcccattttatagggacaccagtcatatggggttacagcccgccctaatgccctcactttaacctctatgaagaccctatctccaaataacttcatactctaaggtgctgggggtgaccacttcaacatgaatttggtgggagagggcacaatttacctttaaacctcttctctctacccctcaaattatgtgtgaggaaattgaggcccaagccaagtagtttgatttgcatttaggcctgactctaaaatgatacattttcatcacatcctgtttcctactcatgaatagaaaatactgtgaaccagggggaaaaaaaatgtcttcctcgatctgaatttgattagtgtgagactg

SEQ ID NO: 35935 - DNA, 409 bp, Homo sapiens
gtacataatcatctatgaaacctctccacacttaaggtaatgaatatatccattattcccaaaagtttctgtgtgctcctttgtaatcgctcctttctactccttccacctcgactcaaatttgtctccaggcaactaatgattttctttatcactatggattactttgtaatttctaaaatattatataaatggaatcatatagtaaacactttgttttgtttggtttctttctctcagcataattattttgagattcatgcatgtcattatgtgtattcttagttcattcgctttttattgctgagtagtattccattgtatgaatatacaacaatttgtttattatttaatctattaatggccatttgggttgtctccagttttgagcatttggagattacgaatg

SEQ ID NO: 35936 - DNA, 250 bp, Homo sapiens
  misc_feature 42: n = A,T,C or G
gttacattggggaggttggtattccaccccctgtgccttttnttagctgtattgtattcttattatgtgttttaccgggtaattgtaattcttggctttggattttgtcccttttttaggctgcggggcggggggtcggttattttataagcaaagaagtacagccagtatgattctgaagcaactaggccacagtagaaaaaagttggagagtgaaatctcaagcaagccaaaaagtgatagatgagtt

SEQ ID NO: 35937 - DNA, 358 bp, Homo sapiens
cagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtga

SEQ ID NO: 35938 - DNA, 349 bp, Homo sapiens
  misc_feature 19: n = A,T,C or G
atatttgttaccttttagnaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttac

SEQ ID NO: 35939 - DNA, 245 bp, Homo sapiens
gggagtctgaggaaggaaggggcaaactcatgaacgctattgttctggttctacactttccaatcaaactccttagaagagttatctatactcaatgtctcctgcatgctctgagattagtttaagaacacattcagattttaatcacctcttaccaccttcacttcttcctaaggcagcattatgcactatgacgtgctcctaatgattttgctgactctacacttgctcccaatttattccct

SEQ ID NO: 35940 - DNA, 116 bp, Homo sapiens
  misc_feature 1, 23: n = A,T,C or G
ntcatcatcatttttgagacagnagttgacagtcttgctgcgtctgtcacccaggctggagtccagtgagctgagatcataccattgcactccaacctgggtgacagagtgagact

SEQ ID NO: 35941 - DNA, 218 bp, Homo sapiens
gaagcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagta

SEQ ID NO: 35942 - DNA, 146 bp, Homo sapiens
gtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttg

SEQ ID NO: 35943 - DNA, 424 bp, Homo sapiens
  misc_feature 2: n = A,T,C or G
gnacaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatat

SEQ ID NO: 35944 - DNA, 432 bp, Homo sapiens
gcttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgcaccatttgtttcttat

SEQ ID NO: 35945 - DNA, 294 bp, Homo sapiens
  misc_feature 7: n = A,T,C or G
ctctcangctcaactcacatatttccttttccctgggggggccatcgttgacttctcagtcccatgtttgtctctatttaattcttcttctgatgttcctctccactgcatgatcctctccactgcataatccactcctgaattccctactctggactcaatcaagattttgagttgaactatgttcatctatggaagcaaaagctgggtcctgtggtccttagtgctctgtctctttgatcaggtagtgaaggatttgcatctccaaggactctttttttccaaagccttagc

SEQ ID NO: 35946 - DNA, 328 bp, Homo sapiens
gaaactcaagtatggagtaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacat

SEQ ID NO: 35947 - DNA, 410 bp, Homo sapiens
  misc_feature 1: n = A,T,C or G
natctggtgactcatgatgcccgcaccatccgctaccccgatcccctcatcaaggtgaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatct

SEQ ID NO: 35948 - DNA, 424 bp, Homo sapiens
  misc_feature 6: n = A,T,C or G
gaagantaactttaaaaggatcaggaaattcatgaagtaaaaaagtctcatgaaaataatgacttgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgact

SEQ ID NO: 35949 - DNA, 279 bp, Homo sapiens
aagtaatattccttttaaattttttccaaccattgcttgatatatcactattttatccattgacatgattcttgaagacccaggataaaggacatccggataggtgtgtttatgaagggtggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtctttttttttt

SEQ ID NO: 35950 - DNA, 342 bp, Homo sapiens
  misc_feature 12, 29: n = A,T,C or G
atggcccggganctacatgttgacctagnaacttggaggggctcattatttaatatgacttgaagtgattgtttttcaacttttcattaacagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggtagtagttttatctacctatcaagatgaggcagttaagtgataaaattacttttggccaggtgtggtggttcatgctggtaatcccagcactttgggaagc

SEQ ID NO: 35951 - DNA, 384 bp, Homo sapiens
  misc_feature 3: n = A,T,C or G
gcncgccaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccat

SEQ ID NO: 35952 - DNA, 282 bp, Homo sapiens
  misc_feature 206: n = A,T,C or G
aattaaatgatatagatgaacattcagcgactactgcaacgcaaagtattttgaaaagccaagttcctagttttctccttaactacgaagttgtgaaaatattgattttataaagtctataaaatagtaagcttaatgaatacttatactggccaggtgtggtataagtatacaggcatgggatcatgcctgtaatcccagcactntgggaggcagaagcaggtttgctttgttgccaggagtttgagaccagcctgggcaacatggcgagaccccgtccct

SEQ ID NO: 35953 - DNA, 359 bp, Homo sapiens
cacgtacactgccctgaagatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagact

SEQ ID NO: 35954 - DNA, 369 bp, Homo sapiens
ggctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcct

SEQ ID NO: 35955 - DNA, 183 bp, Homo sapiens
  misc_feature 1: n = A,T,C or G
naccgtgaaacagtctctactaaaaatccaaaaattggctggatgtggtatcatgcacctgtggtcccagatgttcgggaggctgaggcatgagaatcgcttggatgcaggagcggaggttgcagtgggctgtgatcgtgccattgccctccggcctgggcaacagagctagatccttgtctt

SEQ ID NO: 35956 - DNA, 294 bp, Homo sapiens
tatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattggga

SEQ ID NO: 35957 - DNA, 237 bp, Homo sapiens
  misc_feature 12, 14, 89, 93, 160, 210: n = A,T,C or G
tctcgcaatgtngngcatttggagtatttcaatacgggatccaaaaagatccatgcgttgctttggttactgtgtctcttcattctttngcantcttaacacgtctccctttcctccccttttctcttttatgccatttatttgttgaagaagccctggngttttgtcttgtagaaatctcctacattctggatttgtccagctgctggnttgtgatgatgtttaatatgttcttat

SEQ ID NO: 35958 - DNA, 227 bp, Homo sapiens
  misc_feature 35: n = A,T,C or G
gttcattgtggatgttaaagccaacaagcaccagnattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatct

SEQ ID NO: 35959 - DNA, 356 bp, Homo sapiens
ggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcat

SEQ ID NO: 35960 - DNA, 381 bp, Homo sapiens
gggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaaga

SEQ ID NO: 35961 - DNA, 329 bp, Homo sapiens
  misc_feature 12, 14: n = A,T,C or G
gtttgactcaantngaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataacagccaccagttgactaggtcagcctgatatactagtggatcactgtccaagataaaaaggt

SEQ ID NO: 35962 - DNA, 374 bp, Homo sapiens
ggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatga

SEQ ID NO: 35963 - DNA, 273 bp, Homo sapiens
tatatcctatagtcatacctttatctgtctatttatatctatctagagtgaaagagaatagacaaagttttttcttttattttctaatatgtttacacgacacaccaatgttcctggctcagcatggcacacttggtgtctgtacacattcagtggaacaaagcaagtcatatggtaaagtataccatcagtacagtgaaaaagaatgtggctatcatagtgggagacatttgagagataaataaataaaaataatgaatatttgattttact

SEQ ID NO: 35964 - DNA, 291 bp, Homo sapiens
  misc_feature 2, 10, 208: n = A,T,C or G
anaatcaaanatgaattaatagcttttcacttggttccagtggcagaagaactttgcgcatagttaaatggtgtcattatcaactatttcaaatagaaaataatttcatttaacaaattgcttgaggctgggcacatagtggctcatgcctgtgtaatcccagtgcttttggaggccaccatgtgaggattgcttgaagcctggagtncaagaccagtctgggcaacattgtgagaccccatctctacaaataaaaactaaaaaaaattagccaagtgtggtggtgcatgc

SEQ ID NO: 35965 - DNA, 434 bp, Homo sapiens
  misc_feature 36: n = A,T,C or G
ggtaggagcctctctccctactgctgctacacaagnaccctgagactgacctgcaggacgaaaccatgaagagcctgatccttctcgccatcctggccgccttagcggtagtaactttgtgttatgaatcacatgaaagcatggaatcttatgaacttaatcccttcattaacaggagaaatgcaaatactttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtat

SEQ ID NO: 35966 - DNA, 105 bp, Homo sapiens
gtaaataattagctattacgttctattaagttgttttatattttaattttctggaagactattttattttacaacgtgaacccaaataaagtaacttctgtgttt

SEQ ID NO: 35967 - DNA, 360 bp, Homo sapiens
  misc_feature 3: n = A,T,C or G
ggnaatgaatgggcataggaaagcaatgaatgaatgggaagatctcaaacatacgtggctccagaaagagagcaaaccagaggcttgccatagaaagtgagttgtaagtcagcttgggcaggtagcaaatccctgaagccataaccatttgtccagtcgagcattcactatggtggtgagatggggcagtttcattgcctcccctttggggaccaccttgctacccctagtgtcatacctcagtgctctccagttatttccctctgtggcaagagtggctttattttcttctcttttgggtattacccaggacaaacagtggatgtgacgatggatggtaaaggtacgtcatcattccct

SEQ ID NO: 35968 - DNA, 277 bp, Homo sapiens
  misc_feature 6, 8: n = A,T,C or G
ctcggntnttatggcccggggttttggggggaaaattttatttcccttttcttctgatatttaaaaaattcatcgatctttcaagatgaaccaaggttttttaaaagaattataggaaacacttcattctttataaaactttctataatgccttatttgaatgttaatcttatgcgctttctaaaaaatgttgtgaaataccaaacttatggattatcactaggttatcaagcatatattagtctttatcagaataaaatgaaatttcataactgtg

SEQ ID NO: 35969 - DNA, 179 bp, Homo sapiens
  misc_feature 7: n = A,T,C or G
gatggcncggggaacacagcaatcctgtatagcctatataccagtaggagaaactcagaatttcttttcaggatactaaggaaatggtggtcagaagaggcccgggacggatgaaattcaccaaagtctctaccacagacattctcagatggtcctaataaaaagaagaaacccaaatc

SEQ ID NO: 35970 - DNA, 251 bp, Homo sapiens
  misc_feature 5, 199: n = A,T,C or G
atggnccggggcagcaaggtaaaactgcactcttaatgagcaaaagctttataagttcaagggctgtaaaatatgaactacttagggtcgtcttgccttccatgggaacttggctagacttagaaaaagctgtttgttgtgctaatgtaaaagtgtcatacaatttagaagatttttgaagatggtaaacttagaaganttctatgttctgaaatgcacacttttagaatgtttttctttgaaaacaggct

SEQ ID NO: 35971 - DNA, 297 bp, Homo sapiens
  misc_feature 1: n = A,T,C or G
natcctggctatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcct

SEQ ID NO: 35972 - DNA, 159 bp, Homo sapiens
cgactcttaacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttac

SEQ ID NO: 35973 - DNA, 149 bp, Homo sapiens
  misc_feature 1, 2, 40: n = A,T,C or G
nnactttattaaaattaaaaattttctactttgtaaaagnacaccataaagagaatgcaaagacaaatcacacactgggagaagatatttgtaaaatatctatctgttaaagcactgttattaaaatatgcaaagaactcttaacactc

SEQ ID NO: 35974 - DNA, 301 bp, Homo sapiens
aagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctaaga

SEQ ID NO: 35975 - DNA, 369 bp, Homo sapiens
  misc_feature 31: n = A,T,C or G
aagtgaccgatgttcaggacaacagcattantgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcttgagcgcccaatggacaccacccaatgttcagctcactggatatcgagtgcgggtgacccccaaggagaaga

SEQ ID NO: 35976 - DNA, 316 bp, Homo sapiens
ctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagaga

SEQ ID NO: 35977 - DNA, 273 bp, Homo sapiens
  misc_feature 32, 37, 225: n = A,T,C or G
gatggcccgggacggcatcaagtcagtaaggnatatncgacaaggttcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagncatgacattcttagctgtaacttaactattaaggccttttccacacgc

SEQ ID NO: 35978 - DNA, 138 bp, Homo sapiens
  misc_feature 15: n = A,T,C or G
gtgtggccgagcagnatggctatgtgctagagggcaaagagttggagttctatcttaggaaaatcaaggcccgcaaaggcaaataaatccttgttttgtcttcacccatgtaataaaggtgtttattgttttgttccc

SEQ ID NO: 35979 - DNA, 385 bp, Homo sapiens
gagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtg

SEQ ID NO: 35980 - DNA, 302 bp, Homo sapiens
  misc_feature 10: n = A,T,C or G
atgggccggngactgtaactactatggtagcactgctaaccaatcactcggcctccagctactcctgtctgcagcacattctatactgtgctaccgggtaatatttttaaaatgcagttcctgtgtgctcagaagccttcagtgattccctttcttactgaacattgttcttgatattgtatttagtctttagtcaggttctaacctattttctgagttatttctctagttcttccttttgagtatactatgctctatttcctgtgtaactaggaaatccagagtgagattagcagttctta

SEQ ID NO: 35981 - DNA, 378 bp, Homo sapiens
  misc_feature 1, 18, 28, 216: n = A,T,C or G
ncctttaataactttagncatttacagnaaataattataatgcagggtataatgtgataaatgacatgagacgtcctcaccaaatactaaaatacagcagattgttttaagctccagttgaaaatagtataaagttccttttctctctaataaggtatgaaagttcttaaagttataataagcccccttccctttctgccatccttcaattgctgnaaaccatagagcttattgaatatctaagcagagagctacatctgtttatgcacattgggaacaattgaccaacaagtacgagttgaatccgttgcctgaaataaaaggcacaagaagtactagaagttaataaaaaaagacccaatagttttgtctatgaga

SEQ ID NO: 35982 - DNA, 263 bp, Homo sapiens
taggattataggcatgagtaaccatgcttgtcccatatttttaacatttcagtaactgcaagtctggaagatccctatatcaaatggttccacattaaagtaatttacataataaaaataatcctaaaaataaaacagaagtcaaggaaagaggcttaaacaaaaatcaacaataattaaataccccattataaaataaaaatattaatttctcctaaattatgtgatattttggaaatgtccagtaactatcataatatgac

SEQ ID NO: 35983 - DNA, 324 bp, Homo sapiens
  misc_feature 211: n = A,T,C or G
gaaagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaatacnttcatatcccctcagcagagatggagagctaaagtccaagagaggatccgagaacgctctaagcctgtccacgagctcaatagggaagcctgtgatgactacagactttgcga

SEQ ID NO: 35984 - DNA, 358 bp, Homo sapiens
aagaaatgagtatactaaaaaactcgtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacggcaaatgaaatacaatcatgcttgaaagatttatttaaaactattttcatataaaaaataagaaaaattaacatttctacaataaaaagtggaccctaagtgaaatttatattctattgtaattttgcaggccacaaaatttgtagaattaggctgtcttctgaatttcatg

SEQ ID NO: 35985 - DNA, 285 bp, Homo sapiens
ggaacagaaggttgtcccctcaggaaggagtccaatttgctgtggtccccacatcacctgtttgctacctgtttgatcctctcaggcttttggttttgtcacccctgacttactgttcgtttaaaatcttatcctaaaaaatcaagagatctttaggttcaacaaaacaacctttttttttgttgagatggggtctcactctgttgcccaggctggagtgcagtgagccgagatggcgccattgcattgcactcccgcctgggcagcaagagcaaaactacatct

SEQ ID NO: 35986 - DNA, 248 bp, Homo sapiens
  misc_feature 7: n = A,T,C or G
gaaaacntgtcaaacacatggctaatgcctcatgcttcactcattcttgcgtaaacctgcatagccaccatccattatacccttggtaacaacacaattctgcaagtaaatattgttacactaagtaacctttcaattcaagttgtttaggaagagaaaatgcaatcttgtgcagtcagttccagtgtcagtttaatgtttcaaaagggaagtggtgtagagaataagtatctgtacagtgacttgct

SEQ ID NO: 35987 - DNA, 359 bp, Homo sapiens
  misc_feature 2: n = A,T,C or G
angtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtccgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagc

SEQ ID NO: 35988 - DNA, 307 bp, Homo sapiens
  misc_feature 2, 10: n = A,T,C or G
angaaacggnaatttataaatcgaattaattaggatgtgttattttgttttacaggaagaatgaagaatgagtgtaggagttacctatagtttctgcctaattatttaccaatctggacttttgaacaaacattttttttaaagacggggtctccgtcgcccgggctggagcgcagtgacacgatcatgactcactgcggcttctgtctcctgggctcaagtgatccccccacctcggcttccgaagtagttgggactacaggcacgcgccaccacatccgtctaatttttgtatttttggtagaga

SEQ ID NO: 35989 - DNA, 310 bp, Homo sapiens
agttcatggtgcagtcataactcctgggagttccccccacagtgggggtgtggttcccagagcaagtgaggggaagacttgtgatcaggtaccttctctctctattaactatgtaactattagctacataattgccattgggaagattttacttttggtattattatccataaagatattgataaatattttgtgacaaagcattggccccatggcactgctcatgccagtttaccatcaataacaatttttttttattttgtgaacttaaaatatttatgaatgtcttattttatgaactgctgtgaga

SEQ ID NO: 35990 - DNA, 224 bp, Homo sapiens
ggaagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccaataaagaatcaatactgcttcc

SEQ ID NO: 35991 - DNA, 170 bp, Homo sapiens
  misc_feature 170: n = A,T,C or G
aaggagacagcagctccatgcatgttactgtcctgaagaccttccagtgggacaagatgtgttggtggaagacagtgatactgatgatcctgaccctctgtaggcctaggtttatgtatgtgtttgtgtcttagttttaaacaaaaaaaagtttaaaaagtaaaagagtn

SEQ ID NO: 35992 - DNA, 259 bp, Homo sapiens
  misc_feature 14, 33: n = A,T,C or G
gaagaaatgcaagnaataaggtgggatgaaagnatttttgacaagagttttttaatgaacctgaaacgggaaagggcgagattaactaagcctgtttgccatggacagcaatggggttgctagaagattagctgtgcggaaaaattatgcatttacctttgggcataataaaatgcaattgactctccatattcatgggttctgcatccactgattcaaacaactgtggaacaaaattgtcagaaaaaacaatacagtg

SEQ ID NO: 35993 - DNA, 310 bp, Homo sapiens
tacaggcagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagc

SEQ ID NO: 35994 - DNA, 433 bp, Homo sapiens
  misc_feature 22: n = A,T,C or G
attgtaagtcattataactagnatttcagatgtttataagttaactagagataaggaagatgtaagaaaaagacccaaatcgaacttctagatgaaaaatacactgatgtttgagatattccatgatttaaaaagaaaacaaaacaagacaaagcatgtcctcgaataaatttttcctcatcaccatgagttgaagccagaactttcctggcatttcctttcacatgaatcttgaaacaaaaaccaactaagtataaattagtctctctttcacctcctgcagtctttattcaatccagacccattatttctgcctctccaagtacacacccacatattttatgtttgctaaaacatttgaagacaatctttaataaagtacaggtatacctcgtcttactgttcttgacattattacacttcacagatattg

SEQ ID NO: 35995 - DNA, 133 bp, Homo sapiens
aaccagtgtgttttcttatttaactccgtttactacattctacatggtgtttacgtgatccacacttgaaatactagatcagtagacattcactaatataccaaaataaaatgaaaaattgagtttttccgtg

SEQ ID NO: 35996 - DNA, 389 bp, Homo sapiens
  misc_feature 1, 12, 26, 29: n = A,T,C or G
naaagattgagnaaccgtgcttgagnagnagttgagggctgtttcccatttatcatgttgcactgtttgagtttttgcctttctcaaacttgccatttttcatatattatcttacgttttaaatttaattttaatgtgttttctgttcacaaaaatagtgtgtgattacagtcaattcatttttatcaagagagccaagacaattcaagaggaaaagaatagtctttgcaacaaatggtactggaaaaactgtatatgcagttcgatgaaagaatgaaattagactcttgattcatagcctgtgcagaaattaactcaaaatttgattttaaatgttaagagctaaactacaaaactcaaaacatacagataaatctttacgacttaga

SEQ ID NO: 35997 - DNA, 407 bp, Homo sapiens
gcttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaag

SEQ ID NO: 35998 - DNA, 480 bp, Homo sapiens
  misc_feature 8, 48, 426: n = A,T,C or G
gattttgncccagggattcggtcttatggccgaggtttggacatgagnaatagataagattaaattacaatttacaagatcacttcattaggcacaggaaaagtatttaacaaaattcaacaccctttcacaataaaaaataaaaaataaaaaaccctcaacaaactaggaatagaaggaaacttcctcaacctgataaagggcatctatgaagaacccatggttagcatcatacttaatggtgaaggactggattatttccccctgagatcagaaacaagacaaggatgtctgctttggccatttctattcaacttgtactggacagtcaagaaagggcaattaggcaagaaaataaaataaaagtcatctaggttggaaagggaagaagtataactaaatagagatgggagacgatttggtggntttgtgcatagtaatccaagggaaaactatagaaaatccaaaggcatgatttat

SEQ ID NO: 35999 - DNA, 139 bp, Homo sapiens
gggcatggtggtgggcgcctctaatcccagctaccagggaggctgaagcaggagaatcgcttgaacccaggaggcagaggttgtagtgagccaacattgcgccactgcactccagcctgggcaacagaacaagactcca

SEQ ID NO: 36000 - DNA, 230 bp, Homo sapiens
acctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatct

SEQ ID NO: 36001 - DNA, 369 bp, Homo sapiens
aaccctaaggaagggtccatctgctttgattgtaatcgggcacagtcctggacaccgagtccctttctgtcaggtgcgaaaagcttggggaatgcatcttggtcatgggttgctactaaaatgagcgtgtcatcttcaggggacaggaattaaaggcacagagaaaaactgaaattatttagcttcccttcccttctcccttcttcccatctcccatcccttgccactgattatggtggggctggctttatatattctctagtttctcatatgttgacttatttttgcagtcgtttcagttctaggccatttggtgcattatgttccgcgtttatgggcatgcgctttggaaccaggcagctggcttag

SEQ ID NO: 36002 - DNA, 195 bp, Homo sapiens
  misc_feature 1, 2: n = A,T,C or G
nnttcagaattttggtttacacatcaagtaaacagacacacatacctaggaaagatttacacaatagataatcatcttaatgtgaaagatatttgaagtattaattttaatatattaaatatgatttctgttatagtcttctgtatggaattttgtcacttaagatgagctgcgaataaataataccttcaatcg

SEQ ID NO: 36003 - DNA, 440 bp, Homo sapiens
  misc_feature 2: n = A,T,C or G
cnttatggccggggtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccagctccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacaga

SEQ ID NO: 36004 - DNA, 253 bp, Homo sapiens
  misc_feature 1, 10, 14: n = A,T,C or G
natccaaatngggnaagaaaaaataaacctatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatag

SEQ ID NO: 36005 - DNA, 321 bp, Homo sapiens
  misc_feature 10: n = A,T,C or G
atggccgggnatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctcta

SEQ ID NO: 36006 - DNA, 238 bp, Homo sapiens
  misc_feature 235: n = A,T,C or G
aagtattgttaaagtaataaagttattttgcaaagtgtaacccattttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcangac

SEQ ID NO: 36007 - DNA, 414 bp, Homo sapiens
  misc_feature 1, 14: n = A,T,C or G
ncttatggccgggnattgaaacaaatgaaaaatagtctcagcaaagaaatagaaaatgtaaagaacaaccaaatgaaagttttagagtgaaaaatgtaataactgaaataaaaggctatgtagttgtacccaacaaccaagtggagtgggaatgggggtacagaagaatcagtaaactggaagataaaacagtagaaacagcctaaacagcacagaaaacaaacttaggctgggcatggtggcttacacctgtaaccctagcattttgtgaggctgaagctggagattgcttgagccaggagttttgagaccagcctgggcaacatagtgagatcccatctctccaaaaatatacaaaaattaaccaggtgtggtggcaggcaactgtgatcccagctacttgagaagatgaga

SEQ ID NO: 36008 - DNA, 429 bp, Homo sapiens
ggcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcacctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgagggagga

SEQ ID NO: 36009 - DNA, 407 bp, Homo sapiens
atctgccgtagtcccagctacttggtgggctagggtgggaggattgcttgaatctgagagtagtgggagtatgatcatgccactgcactccagcctgggtgacagagaccctatctccttaaacaaaaaagtaaatggattaagttctctagtcaaaacacatagtggctgactggattaaaaaagaaagacctaaggtatatgctgcccacaagaagctcactatagctttaagaatgcatgtagcccgaaagtaaaaagatgggaaaagacattccacgtaaatggaaaccaaagagagcaagggtgagtagggaaagatcttataccagcttaatgttacacctcaagttactagaaaaagcagcagctaagcccaaagtcagtagaaggaaaaagaaactaag

SEQ ID NO: 36010 - DNA, 472 bp, Homo sapiens
gctaaacctagccccaaacccactccaccttactaccagacaaccttagccaaaccatttacccaaataaagtataggcgatagaaattgaaacctggcgcaatggatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgt

SEQ ID NO: 36011 - DNA, 281 bp, Homo sapiens
  misc_feature 2: n = A,T,C or G
gnatgcagctggagaccttatcctaagcaaaccaacacagaatcagaaaaccacatgttcttgcttttaagtgagagctaaaccttgggtacacatggacataaagatgggaacagtagacagtggaggctatgataaaaagaagggaagtggggcaagggttgaaaaactaactgttgggtactaggcttaactacctgggtgttgggaccatttgtatcccaaaccttagtatcatacaacatacccgtgtaacaaacctgcatctttactctctgaat

SEQ ID NO: 36012 - DNA, 324 bp, Homo sapiens
caacaaaactaaaacactataattcaatgaacaacttatttaagaaaatcaagtctccttaagaagtatccgacaaacctcctctcacggtcgccctacttcagatgctaagatgtagctacctgcaagcttcatgatccatcgtgcatgttaaaagcatttcaaaggctctgagaagttctgccgtaaagaaacctgtgtaactccatgaaacccagagttttccaaactgaccagggaattcatttttgttttttgtttttttttcctggccgctttgagcacagctccataggagccacttcagggattgctggcctggat

SEQ ID NO: 36013 - DNA, 180 bp, Homo sapiens
  misc_feature 4, 13: n = A,T,C or G
cagnaacagcagnactcagctctgacattctgattcgaatgacactgttcaggaatcggaatcctgttgattagactggacagcttgtggcaagtgaatttgcctgtaacaagccagattttttaaaatttatattgtaaatattgtgtgtgtgtgtgtgtgtgtatatatatatatatg

SEQ ID NO: 36014 - DNA, 275 bp, Homo sapiens
tatggccgggaagtctgggaggataattgggatgatgacaatgtagaggatgacttctctaatcagttacgagctgaactagagaaacatggttataagatggagacttcctagcatccagaagaagtgttgaagtaacctaaacttgacctgcttaatacattctagggcagagaacccaggatgggacactaaaaaaatgtgtttatttcattatctgcttggatttattagtgtttttgtaacacaaaaaataaatgttttgatataatctt

SEQ ID NO: 36015 - DNA, 313 bp, Homo sapiens
ggccattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcgacgttaccaacaagacagatcctcgctccatgaactcccgtgtattcattgggaatctcaacactcttgtggtcaagaaatctgatgtggaggcaatcttttcgaagtat

SEQ ID NO: 36016 - DNA, 162 bp, Homo sapiens
  misc_feature 7, 18: n = A,T,C or G
tcttgtncccagggaaanctcggcaattatggcccgggggtgatgtgttcgacgttttatcaaaggccccctttctatgttcatgttagttttgctccttctgtgtttttttctgaaccatatccatgttgctgacttttccaaataaaggttttcactcct

SEQ ID NO: 36017 - DNA, 177 bp, Homo sapiens
  misc_feature 3, 4: n = A,T,C or G
gannaagttttgctggagacctgcttgccccatatgtctggtcctgatagatgaggactggccaggtcaggacagctgacacttggagaaggggctgccccaggagggcatgacagactctggaaaaggagggtcggagtattaaactggctgggaatgagaggcctccaatctttt

SEQ ID NO: 36018 - DNA, 457 bp, Homo sapiens
  misc_feature 3, 10: n = A,T,C or G
aantcggccnttatggcccgggtgcctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagataggagtgtccttggtaattaagaagtcaggagatttacaatatgactttaacattaaggtttatgggatactcaagatatttactcatgcatttac

SEQ ID NO: 36019 - DNA, 481 bp, Homo sapiens
  misc_feature 38: n = A,T,C or G
tatggccggggggtaccctttggaaagctctcggagancctcacctagatgcctattcaagctttggacagccttcagattgtcagccaagagcccttttatttgaaggttcattcttccccagacttggactctgagtcagaggaagatgggaaagaaaggacagattttcaggaagaaaatcacatttgtaccctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttt

SEQ ID NO: 36020 - DNA, 241 bp, Homo sapiens
  misc_feature 2, 20, 27, 42, 43, 47, 48: n = A,T,C or G
gnatttttctccccgggaantcggccntttatggcccggganntgannaaaatggctcaagtaagagtgaaatgggttcacccttccccggaaacaggctgagagagccctgtggctaaaatgagatcggatgagtggaatgaaatactatctggaccttccaggattgcaccaccccagccatagcaccccaaggactggggagaggcagatcacattcaaattaattttgtacatgacc

SEQ ID NO: 36021 - DNA, 439 bp, Homo sapiens
gagcccgggatggaccttcacacccagtagtactgcgatccgcccccaagtcaggagtcattgacctaagacaccaacagggctgtgtcttattacacgttcccagtgcctcctcctgcacctggttaggcttgctgaatgaacaaatgaatgaaagaatgggtgaattaggttgggtgctgtggctcacacctgtaatcccagcactttgggaggctgaggtgggtggatcacctgagttcaggagttcgagaccagcctggctaacatggtgaaaccccatctccactaaaaatacaagaaataggtggtggtgggcacctggaatcatagctacttgggaggctgaggcagaattgctggaacctgggaggcggaggttgcagtgagccgagattgggccactgtgctccagtgtgggcaacaagagcaagacact

SEQ ID NO: 36022 - DNA, 168 bp, Homo sapiens
ggaagacatttcttttattcttcgtgtatgaatttaaagctattttttgtaaatatttctaatcagcgataatttctacctatgttctcaacccaacttagcccaagtttgtttttcagagcctgtagtcttattggaaatctattttatcagtgtgctttattgagt

SEQ ID NO: 36023 - DNA, 190 bp, Homo sapiens
  misc_feature 2, 19, 27, 46, 68: n = A,T,C or G
gnttttttccccagggaanctcggccntttattggcccggggcccngtcctcattttcatcttcttcntggttccccagaagcctttgtttcttgggcaagccagaaaaattaaattgtaccctattttgtatatgtgagatgtttaaataaattgtgaaaaaaatgaaataaagcatgtttggttttcc

SEQ ID NO: 36024 - DNA, 222 bp, Homo sapiens
  misc_feature 8, 23, 37: n = A,T,C or G
ctcggccnttatggcccgggatnctaaaataggaaantatgtacctccttaatatgtatttaatatgccctgacttgttttcctgatcacagtgaatttatcagtaagtataaatgtagacagaaagaaatatactaaactgaaacaagctggtgtgaacagaaatattctggactttgtgatcaggtgtaacttaaaaacaaaaaaattttaaaacaaacc

SEQ ID NO: 36025 - DNA, 452 bp, Homo sapiens
cttttcacaagatggcgcccgaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtgggatgttaaagccaacaagcaccagattaaacaggctgtgaagaagctgtatgacatttgatgtggccaaggtcaacaccctgattcggcctgatggagagaaagaaggcatatgttcgactggctcctgattacgatgct

SEQ ID NO: 36026 - DNA, 466 bp, Homo sapiens
gagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctaccatgaagaagatagaagacaacgacacacttgtgttcattgtgggatgttaaagccaacaagcaccagattaaacaggctgtgaagaagctgtatgacatttgatgtggccaaggtcaacaccctgattcggcctgatggagagaaagaaggcatatgttcgactggctcctgattacgatgct

SEQ ID NO: 36027 - DNA, 250 bp, Homo sapiens
aatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttag

SEQ ID NO: 36028 - DNA, 141 bp, Homo sapiens
ggccgccagtggctcatgtctgtaatcctagcatgggaggcccgaagcagaagggttgcttgagccttagaagtttgagaccagcctgggcaacatagcaagactctgtctctaaaagaagaaaaaatttaagcttttctt

SEQ ID NO: 36029 - DNA, 211 bp, Homo sapiens
  misc_feature 19, 21, 42: n = A,T,C or G
tatggccggggttgaagancngcctgggcaacatggtaaganccccatctctacaaaaaataaaaaattagccaggccctggtttgaagcacctggtaatcccagctacctcgaagtataagatgggaggatctctagagccccaggtgttcaaagttacagtgagctatgattgtgccatttcacttcagtatgggctataccctgtccc

SEQ ID NO: 36030 - DNA, 111 bp, Homo sapiens
  misc_feature 23, 81, 82, 108: n = A,T,C or G
atggtaagagagaatgaaggagnaacattatgttttggattttcttgctgaaatggcaccttctcaaagaaatagggcttnncctttgttaatcagctgtgggccagngct

SEQ ID NO: 36031 - DNA, 466 bp, Homo sapiens
agctgaagagctttttttagtggctgtcttgcggagttcgtgttagctggactctcctgaaatatagattcttaatttgggccattgaccatccctgagttgaagcccaaaactacatagcacatacttattatcatgctgtttatgtcgtctctagttacttgaaaacatgtatcacagtgggtcagtgggcggccatcccagattaggggtcaggaaaggcttcccagcgaagataaagcttgacctagccttaagaaacaagggaaatggtaacctaggcagatagaagtgagtaacacattgtcagaaatgggaatggttctgcatgtcttcagtataatgtgaaagcatggagaagtctggtaaaagataaacaggggttcagaccacaaagagccccagtctgtgaagtttgctttctatcttgaggataaggtttccagcaaaggtaagactgaaagca

SEQ ID NO: 36032 - DNA, 460 bp, Homo sapiens
attgagagtgggagccaagtcttcaaatgagcaaaggcactttaaaaaggtaggagaaacaacccaaaaaaaggaaaagggtagttgggggatgcaagtaaaagtggggacaggcaggcattggagaaagtgtatgagctgagctagcaggcagagggctcgaagcaaacaatgtaaaagaaccattggactttgtggttcgtggaatgcttgtgtgagtattgatgacactgatgacaatggggagtaggagaatggaggggccgtcctcaaatgtactgatactttacatcaattcaggcactggaaagatcatggcaagaaaaagaagcaaaataagccagttttaaattattgacaattagacttaatccaaagtttcagcttttttggaacaaaatattacggttgataacctcagcaaatgtcagaattggaatgtaaagcagttttgttttat

SEQ ID NO: 36033 - DNA, 427 bp, Homo sapiens
  misc_feature 1, 13: n = A,T,C or G
ntacacgaatagnacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttaaaataagaatttgcatacttacctagtgaaacttttctagaattatttttcactctaagtcatgtatgtttctctttgattatttgcatgttatgtttaataagctactagcaaaataaaacatagcaaat

SEQ ID NO: 36034 - DNA, 464 bp, Homo sapiens
gtcgtgaaaactacccctaaagccaaaatgggaaaggaaaagactcatatcaacattgtcgtcattggacacgtagattcgggcaagtccaccgctactggccatctgatctataaatgcggtggcatcgacaaaagaaccattgaaaaatttgagaaggaggctgctgagatgggaaagggctccttcaagtatgcctgggtcgtggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgtttggtgaatttgaagccggtatctccaagaatgggcagacccgagagcatgcccttctggcttacacactgggtgtga

SEQ ID NO: 36035 - DNA, 169 bp, Homo sapiens
  misc_feature 2: n = A,T,C or G
cnttatggccggggggcttaagggtagtgtgaaaaataacctatttgagatatactgaatgaaatcatgtggtgaaattccacgggaaatataaagcacattggagtttatgtctttgggacacatgctgcaatagataaaccaaaaactgtagcttttaatcaatgag

SEQ ID NO: 36036 - DNA, 298 bp, Homo sapiens
attctttttaaaaaaaattttggctaggcacggtggctcgtgcctatagtcctagcactttgggtggccaaggcaggatcacctgaggtcggaagttcaagaccaacctggccaacgtggtgaaaccccatctctactaaaaatacaaaacattagccggtcatcgtggtgggcacctgtagtcccagctactcaggaggctgaggcgggagaatctcttgaacccaggaggcggaggttgcagtgagccgagattgtgccattgcactccatcctggcaacaagagcagaactccat

SEQ ID NO: 36037 - DNA, 226 bp, Homo sapiens
atgttaatgttgatttaattttgctttttaaatacacacaataagaatgagagaggggaactcctaaaactaagcgcaaatagcaacagatatattcaaataaactaactgtgaaagggagaaattgaataaaatttcaaagtaataaaataacactgaagagaagagagggatgaatccaagtagattttgaatgaatttgaatgaatccaagttcttagtatac

SEQ ID NO: 36038 - DNA, 135 bp, Homo sapiens
cgggcatggtggcgccctccctgtagtcctgagcctgaggcatgagaatcgcttgaacctgggacgcggaggttacagtgagccgagattgcgccactgcactccagcctgggtgacagagtgagaccccatctc

SEQ ID NO: 36039 - DNA, 270 bp, Homo sapiens
  misc_feature 16: n = A,T,C or G
agcacaatgaagatcnagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgtttttttttgttttgttttg

SEQ ID NO: 36040 - DNA, 472 bp, Homo sapiens
cttatcagctgggttgccttagacaagtgactttatgtctctgaggctcaggttttttaaaaaaatctatttattgtattcttgggatgttttaacaaatcacctcaacactcagtggggtaaaacggtaagaaatttttatttgttactgttcaagagtctttgggtgagctagatggttcttctggtctcagtggtggttctcctgatctcagttgggctgtcatgtctggagattggctgcctctaagctggtctaggattatctcaactgagaggaaagtcatttggactcgcctccacgtggtctctcatcctccagtagagagcaaatggcagtgacagggttccaagacagagaagccaaacttagggtcacctctgctaccttcttttggccaaagcaggtcgcatgacctgcccatattcaaggtatggacaagtcatctcaacctcttgggagaagcagcag

SEQ ID NO: 36041 - DNA, 251 bp, Homo sapiens
  misc_feature 5: n = A,T,C or G
gagancccggtgcgacgtttccctttccagctttgttcttccggccctgctgtctgcctccccggctgattggattcgttactgctttgcaacgcgcacctaactccaggctggagtgcagttgcggtgggccgagatcacgacactgcactccagcctgggcaacagagcgagaatccgtctcaaaaataaaataaaataaaataaaataacataaaataacataataaaataaaataaaataaaatcac

SEQ ID NO: 36042 - DNA, 331 bp, Homo sapiens
gcttttttcttttttccggcgctcaagagtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttatttttgaagataatg

SEQ ID NO: 36043 - DNA, 144 bp, Homo sapiens
  misc_feature 5, 17: n = A,T,C or G
tcccngggaattcggcnttatggcccgggatttgaataatgtgtcattgctgcttttagttggatagaaggaaaacagtttctttctgctgaaaacagccctgtaaaactacatatgtaatttagagaagagatttttttagtg

SEQ ID NO: 36044 - DNA, 197 bp, Homo sapiens
agatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaaggg

SEQ ID NO: 36045 - DNA, 251 bp, Homo sapiens
  misc_feature 2, 28, 35: n = A,T,C or G
cnattatggccgggagaagagaaggaanaatttcngctcatttcatgagacagcattgtcttgatatcagaaccttagccaaaacccaccaactaatatctctaatgaacataaatgcaaaaatccttaacagaatttcagtgaatcaagtccaacagtacagaaaaagttttatacattttgaccaagtaaagtgaatcccaggaattgtagattggtttagcattcaagaatcaattaatgtaactcac

SEQ ID NO: 36046 - DNA, 160 bp, Homo sapiens
  misc_feature 22, 34: n = A,T,C or G
ggttcactaaattgatttagtnagaattcctagnactgaagaacctaaacaaaaaaatactttaaagatataaatatatgctgtatatgttatgtaatttattttaggctataatacatttcctattttcgcattttcaataaaatgtctctaatacaat

SEQ ID NO: 36047 - DNA, 267 bp, Homo sapiens
  misc_feature 264: n = A,T,C or G
gtgaaaatactctcgaataaaaatattttttaaggcacatctaaatgccatctttctgcccatccttcatcaatcgtattgtttagttacagagattctggacatttagaaagagttgaaaataaacaactgtatgcaattaagtgtaaaatctgtggtatataatataactaaagggaaaaatcattgagtgggtagagttagaagtgttacaaagaaagtgggtttgaccttagtcttaaaggaatgtcaggttctttgganaag

SEQ ID NO: 36048 - DNA, 372 bp, Homo sapiens
  misc_feature 34, 371: n = A,T,C or G
gttcttgtgtcttatttgattcttctgctgtgcncattgtattggtccttgttgcatgtagtctactgtgtgttttccgattttataaggcagcatttctccatacaaaaagaaaaaaaatgatgtacatataaacgcttttgttgtatggctcctccatgttactgtatatatctgccagcacttcccagttacactcctgtgagtcagcttatttttaccctaacataaatagtatgttttgtagtagttatcaaatttaagagataaagtaatcagaatgtttggattttcttctatcttaatgtgaatttcataattaatgtctatttattcagctattcattaaaatacaggattctttgggaaanc

SEQ ID NO: 36049 - DNA, 365 bp, Homo sapiens
  misc_feature 1, 7, 54: n = A,T,C or G
ntccccngggaattcggcctttatggcccgggattgtaatggaattcgaaaganttcatgttcacagaacctcaacgttcaggctaatatttacagaagggaccaaatctaaatcctggtagataacctcctgtatgcctttatccaaaggacaccccacagttttccagcatagatataaccaaggatgaattgattccttcaaagaactgggaggcacggatattgcattttttgtttacatccagtagccaagacgcctcagtgagccagtcttgggcagaggctgtcacatttaggcagatttggaagttggtatgttctaattctcactctggactacagtgaggctgaatttatcatgc

SEQ ID NO: 36050 - DNA, 116 bp, Homo sapiens
gaggagagaagaaagagagacagaggattgcattcatccgttacgttcttgaaatttcctaatagcaagaccagcgaagcggttgcacccttttcaatcttgcaaaggaaaaaaac

SEQ ID NO: 36051 - DNA, 375 bp, Homo sapiens
gaggtggtagttgcacagcattgtgaatatactaagcatgactgaattgttcactttaaagtgtttacttttatgttatatgaattttgcctcaataaattaaaacaattttgttaaagacataggagtctggctttgttcatagcaaaacgggttgtattagactatttctcctgtgttaaaaattatgaaccctcgataaaatacgaaaaaaggtatttgaaggccttgtagagcaaccaaaagcaggcagaaactagagggacgtcaacccttaaaagaagggaatcatactgggtgcgatcacatttatatagcctttcttccaaccgctttccagtcatgtggcatagacaacgatatagaactcaaaga

SEQ ID NO: 36052 - DNA, 323 bp, Homo sapiens
  misc_feature 12: n = A,T,C or G
ataaacatgagnagaacacagcaaaaatttggaagccagaaataaaagctgacttctagtgtttaagtcctgccttaactttctgttcccagttcaatatttcgactgatccctttgattaatattataattaagactagttttaaggtttaagattaaatgtttccatctttctttgaataccctccatttaacaaatgacctgcaaaacaaagcaaagactcttcttagtcttcgggtagaaaagggatttttaaatttgaaggcaaaacgtgatttgtctttagctatcccttctttagaaatgaaggctatggcaaaga

SEQ ID NO: 36053 - DNA, 439 bp, Homo sapiens
  misc_feature 13: n = A,T,C or G
gacaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtagagaga

SEQ ID NO: 36054 - DNA, 357 bp, Homo sapiens
  misc_feature 21: n = A,T,C or G
atggccggggtctgagcgaanaagcaaggtcaatgggagggtgaaatgaagcagtcacaaatttagttgcctcctcttaaaatcgatgtcactggactgaatctgggagaatgcagatgcttgtgcaacaaattctgccccagcttcccaatgttggagaatgattgattttaccagaacattctcccactcattgcattattcattgtgtagtggggtcagcagggtgtggcctgctacctctgtaaaggaggcagggatgacgccctcgtttcatgttagtactacttgttttacccagacactgggtgcctgcaggaggctcagaaatgacaattttattttaaagaaaatatt

SEQ ID NO: 36055 - DNA, 261 bp, Homo sapiens
  misc_feature 1, 21, 30, 215, 217: n = A,T,C or G
nccggggacctttcggccggnaaccgcctncttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagngnggccatggcaaaactggaagagtctacaatgttacccagcatgc

SEQ ID NO: 36056 - DNA, 256 bp, Homo sapiens
  misc_feature 2, 13, 30: n = A,T,C or G
gnttcaatgcagnattgttggaccttcagnatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttg

SEQ ID NO: 36057 - DNA, 335 bp, Homo sapiens
attataatcctgtagaagtcctaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgatttttttgttcattctgatttgtcattttattatctgttatcggtctaaagtgctaatttac

SEQ ID NO: 36058 - DNA, 399 bp, Homo sapiens
ggaattgtggaagtggttggaagagtaaccgccaaggccccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttcccatatttaatttgctgtttttaagatattccaacctagagtttttgatggaactgatatattgacagttctcacccgaagtccttttataaagaattgctactccaatatatggtcagattagatgcaagaat

SEQ ID NO: 36059 - DNA, 454 bp, Homo sapiens
  misc_feature 13, 306: n = A,T,C or G
gcttttcacaagnatggcgccgaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttntttgtgggatgttaaagccaacaagcaccagattaaacaggctgtgaagaagcctgtatgacatttgatgtggccaaggtcaacaccctgattcggcctgatggagagaaagaaggcatatgttcgactggctcctgattacgatgct

SEQ ID NO: 36060 - DNA, 209 bp, Homo sapiens
gcaggagttcaacaccagcctggccaacatggtgaaaccctgtcactactgaaaatacaaaagttagccaggcatagtggcagatgcctatcatgccagctacttgagaggctgaggcaggagaattgcttgaacccaggaggcagaggttacggtgagccaagatcatgccacttcactccagtctgagcaagggtgagactccaccc

SEQ ID NO: 36061 - DNA, 141 bp, Homo sapiens
acagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccg

SEQ ID NO: 36062 - DNA, 163 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgac

SEQ ID NO: 36063 - DNA, 344 bp, Homo sapiens
  misc_feature 29: n = A,T,C or G
ggaggggagaaggactggaatgtaccccntctcccttgactgcagagcaggttcctccactgccccaccccttagacaccatgaccccatcaggttaatcccctgttgccatggttatggagagcttgcagctgccatcttagatgtgctctttggggaagcccatctaacaggaggacattggtttgggggtgcacctcctgaagaatgggtggggaaggctttctctaggatcagattcaaataaatcaagtatgtattgagtgcctactctgtgcaaggcactatgctagatctggtgcctagaagccctgagaaagaacttaaagagctaggaggacaga

SEQ ID NO: 36064 - DNA, 355 bp, Homo sapiens
  misc_feature 35: n = A,T,C or G
agacttttttagataacatcttctgagtcataacnagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 36065 - DNA, 390 bp, Homo sapiens
cgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaaggtctgccatttctgttcatggtgtgagtacctctggaggacagatgtaccactatgacatgaatacagcatccctttctcaacagcaggatcagaagcctatttttaatgtcattccaccaattcccgttggttccga

SEQ ID NO: 36066 - DNA, 280 bp, Homo sapiens
tatggcccggggtcagcagtgttgttccgttaacctttttgtaaatactgcttgaccgtactctcacatgtggcaaaatatggtttggtttttctttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaaga

SEQ ID NO: 36067 - DNA, 235 bp, Homo sapiens
  misc_feature 25, 162, 166: n = A,T,C or G
tctctatcaaaataccaatgacatncttgacaaaaattgaaaaaaaaatccaaaaatttatatggaaccacaaaagacccagaatagccaaagctatcctgagcaagaagaacaaaattggaggaatcacattatctgacttcaaattatattacagagctntagnaaccaaaacagcatgctgctggcgtaaaaacagacacatagaccaatggaacagaatagagaacccaga

SEQ ID NO: 36068 - DNA, 393 bp, Homo sapiens
  misc_feature 14, 16, 30: n = A,T,C or G
catccaccgccagnanaacctggagctctncgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtga

SEQ ID NO: 36069 - DNA, 119 bp, Homo sapiens
cacggtggcttacgcctgtaatcccagcactttgggaggccgaggcaggcggatcacgaggtcaggagatcgagaatgtcctggctaacactgtgaaaccccatctctactaaaaatac

SEQ ID NO: 36070 - DNA, 359 bp, Homo sapiens
  misc_feature 7, 26: n = A,T,C or G
caatatnttctcttcccccattaatnagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgttt

SEQ ID NO: 36071 - DNA, 300 bp, Homo sapiens
  misc_feature 5, 16, 30, 32: n = A,T,C or G
gtaancaatacgcagnaggaccatatctantnttgtctattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaaga

SEQ ID NO: 36072 - DNA, 347 bp, Homo sapiens
  misc_feature 20: n = A,T,C or G
tagcgacgcccaacacctgnccaaacaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttg

SEQ ID NO: 36073 - DNA, 375 bp, Homo sapiens
  misc_feature 11, 13: n = A,T,C or G
accaggcactntngctgatgcctgtaatcccagcactttgggaggctgaggcaggcagatcacctgaggtcagtagttcgagaccagcctggccaacatgacgaaacaccatctctaccaaaaatacaaaaattaaacgggtatgatagcccgtgcctgtagtcccagctactcaggaggctgagacaggagaattacttgaacccaggaggcagagtctgcagtgagccaagatcacaccactgcactctagcctggtgacagagcaagactccgtctcaaaaaaataaaggacaatataatgcaaagcatactcttctgttaggtctagaccttacctactgtaatagcactgaagactaaggaaagtttaat

SEQ ID NO: 36074 - DNA, 375 bp, Homo sapiens
  misc_feature 7, 31: n = A,T,C or G
ggatgcncttgaaagagtggggcctgctttnagcaatcttctcttgaagccaaaacccatttcctttaccacaaatcatgtaattattgtaatacattaatccttaggtcagtttcaagtgaaaatgaaataatccattctaaatcatagtaattatggaagttgcctatggtatgaattgcacttaccctacagcattgttgaacagatgcagacgaggttggagcccagcagagcaatcccttatgggtacttgcattggagggaaggtaacccagcaaaacagaaatccaagcccttgcttgtatccgtagcctagacaacagcctgtgtgtatgaagaaaccatctgttttcccctctggaatgtttttta

SEQ ID NO: 36075 - DNA, 361 bp, Homo sapiens
gaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttggg

SEQ ID NO: 36076 - DNA, 318 bp, Homo sapiens
tgtagcccttgtcacaacatagtagttacaggtttagaaaggttaaaacacaagagcaattgtacaccgttagtgaaaatgtaaactggtatagccactatggtaaaaacaaatatggaggttcctaaaaaaactaaaagtaaagctacgatagggtccaacattcacacatccgggtgtttatccaaaataattgaaatcaggatctcaaagagatgtttgcactcccacattcattgcagcattgatcaccgtagccaagacagagaaatgtccatcaatgggtgaaaagataaattgtgttatgtacaaagattg

SEQ ID NO: 36077 - DNA, 442 bp, Homo sapiens
cgggcccggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtaccagcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtcttt

SEQ ID NO: 36078 - DNA, 154 bp, Homo sapiens
  misc_feature 154: n = A,T,C or G
tataagctatataaactgcaacgtcttaattaagcaaaggaaattatactttttaccccatactgtttaatgatgtgttaagcattagaagttatattgtttatattgaaatttgaaagaatgcatactaaaatcataatctaggttcacagan

SEQ ID NO: 36079 - DNA, 430 bp, Homo sapiens
  misc_feature 6, 9, 29, 32, 33, 37, 57: n = A,T,C or G
atggcnacnttgggaatgaagaaggacanttnntaanagtgaggcctaaaatggaanccagtcatgatttttattttgctactttctttacggacacgaatgcacacagtgtagagcagccttaactctgaattggaacaaggtcgtgtaagtgccaggacgttatttccagaagcccacagctgctgattcctacacccagtgatttccactgccttttcatgattctggaattcccaagaacagtgtcatcttattagaaggtatttcccagttcgagttggagacaaaccaaccttccctcacaggctgagtccttctggtttcactgccaaagcttccagactcacccagggtctgttagacatatttgaatgaatctgtcagattgttcagtcgttaatgaggtcacactttccatgaagaccat

SEQ ID NO: 36080 - DNA, 119 bp, Homo sapiens
  misc_feature 4, 5, 6, 8, 12, 34, 39, 55, 64, 65, 69, 70, 80, 81, 93, 100,101: n = A,T,C or G
ctannngnatanatgagtcggtacgggcacgaangcccncagggggaggagcagngcataactnngaannggaacaaggnngaggaagaggcnaggacgnnatcatccagaagcccaca

SEQ ID NO: 36081 - DNA, 294 bp, Homo sapiens
  misc_feature 5, 7, 163: n = A,T,C or G
aatcncnattcctggtctgatgttctactagtttttatgctttctgagagcagcatacaaattgtttcacaaaaactctatttacttttcttcaccaccttaaatattaatccccctatgacttaatgtatattattatctattataagaattagaaaggggnctttttaatggctctttgggaatatttttttatatgctttgttcatttttttaaataaatctcttaacttttgagtatgtctgccttttgagctttctcatcatatgacatctttttctacagaattatga

SEQ ID NO: 36082 - DNA, 483 bp, Homo sapiens
  misc_feature 2, 17, 38, 192: n = A,T,C or G
gnggccgggaagggctncaatgacgtggagatccgggnttagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgancaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcaga

SEQ ID NO: 36083 - DNA, 477 bp, Homo sapiens
  misc_feature 3, 24, 52, 53, 179, 180: n = A,T,C or G
ctnccgtattatggattaccatgntttttcttaacccacttgaccaggcagnntcccagcaacacagatcatttgaaaaagtaaattatccatggttactgagtggtaagcaaataaataataaagtctaaatgggagaaggttgtcaagggcagagtgttaattgggttataggaaannaagcaaggggatagggtgtctcccccagctctaacccagcgtctcctgcctacaggtgtctgctccatttagtgtgctggtgtcctgctctccccaccctgtgcccgtcaactctgccctcttccctattttagcatttccatccatgcccttcaagccctctgaccacgtaaccacaacgtctctctcccctgctgttccaggaaggttcagatacaggttgcctgagttcctggaccctcgtggcaccagggacaagagctagttaaaccttgccagctaaaaggttccagaaag

SEQ ID NO: 36084 - DNA, 229 bp, Homo sapiens
tccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacacttcc

SEQ ID NO: 36085 - DNA, 392 bp, Homo sapiens
  misc_feature 2, 4, 24, 30, 31, 32: n = A,T,C or G
ancnccgctctttctagtgcaagnaaactnnnggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctga

SEQ ID NO: 36086 - DNA, 247 bp, Homo sapiens
  misc_feature 18, 22: n = A,T,C or G
tatgtatgtcaagttggnggangccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacact

SEQ ID NO: 36087 - DNA, 126 bp, Homo sapiens
atatttttattgcgaagaagtgatcaagaaaaggttgttcaaacatcaaagtactatatttgaataacattttttgttagagtacaatctaaatatgttagagataataaaagaacaatgttgaag

SEQ ID NO: 36088 - DNA, 297 bp, Homo sapiens
  misc_feature 23: n = A,T,C or G
gagctactagagatattcttatnctcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 36089 - DNA, 100 bp, Homo sapiens
  misc_feature 23, 24, 61, 95, 97: n = A,T,C or G
gtggttaatattgagccaagttnntttgtgcagtttttgaagaggccaagacattaagatntccttagaataaacatcatctggcatcacctgcncncct

SEQ ID NO: 36090 - DNA, 251 bp, Homo sapiens
  misc_feature 1, 25, 198, 211: n = A,T,C or G
ncagtttgtgatttcctcatttttntgtgtggtattatagaggccttacctaatcctctgtgattagctgtggaaaattttgctttaatctttgcaacaggttagatcatgagacagcgaacagcaaaaaaaaattgcaactctgtagtattgaaaaaattttatatggcatatttcttgtaacaaagcatagctcangctgggatttcangcctgagccacagtgcgtggcccacttttattactcctat

SEQ ID NO: 36091 - DNA, 326 bp, Homo sapiens
  misc_feature 25, 151: n = A,T,C or G
gaagtctctcaacaaccagaattgngacccttcttactcctgaaggctctagaaagaacccagctcgcacatgccgtgacttgagactcagccacccagagtggagcagtggttactactggattgaccctaaccaaggatgcactatggntgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttcc

SEQ ID NO: 36092 - DNA, 198 bp, Homo sapiens
gcatctactcttgaagctagatgcatctgtgcttttcacagttagagctgctgatgaacataaacaagatgttaactgacttgtcttacttggcctcagtgcataatcccacatcaccaccatcttcaaagaaagcacctccaccttcaggagcatctcaaaccatcaaatcaacaaccaaacgttcacccaaaccac

SEQ ID NO: 36093 - DNA, 120 bp, Homo sapiens
  misc_feature 23, 24: n = A,T,C or G
tgtacctatattgtgcaatactnnaaaaaaacggtataaaagtattttgagtcagtgtcttacatgttaagagggaccgaaatagtttatattaagtttgtattaaaattctttaaaatt

SEQ ID NO: 36094 - DNA, 311 bp, Homo sapiens
  misc_feature 2, 4, 309: n = A,T,C or G
ancngccaagcaacatgggagtaaagtaatttttccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatntg

SEQ ID NO: 36095 - DNA, 110 bp, Homo sapiens
  misc_feature 25, 96: n = A,T,C or G
accgaggcagtggcaagaaaagggnctttgcctttgtaacctttgacgaccatgactccgtgggataagattgtcattcacaaaataccatactgngaagggccccacct

SEQ ID NO: 36096 - DNA, 266 bp, Homo sapiens
  misc_feature 18, 23, 173: n = A,T,C or G
gatatataatttgctttnttttntaacaggaatacctgagaatgtcctgatgaccatgtaaacaaggtacagtttagggtagaatttctgcagatataagcaaagttttggtacaacaaatggttaatttatcaagtcttctattagtcaaggattgtttgagagtatgctanaactgttgtctgttccttaaccgtgggttttcattgtcttgggatgagaatccatgctttcagattgccagaattctggaagtgttcacagct

SEQ ID NO: 36097 - DNA, 463 bp, Homo sapiens
  misc_feature 23, 24: n = A,T,C or G
caaacagcaactctgaggccatnntttagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcag

SEQ ID NO: 36098 - DNA, 335 bp, Homo sapiens
  misc_feature 25, 264: n = A,T,C or G
tgatatttttttttaacatttaacntaaaatttttcacacataggcaaatttgaaatgtttgcaatgaaattttttatacctgccacctagctattaccatgaatattttagcatacttgctttatcacatatctgtccatttatccatcccacagttctgggtgatttttaccatttttctcagcccccagcatccctttttttagctagatgatgctcacttttataatctctcattatatagatagccacatcaatattgngatcttttgggtagaaaatttaagattgataagtttttagaaaacagcttttatggctaatggggcattta

SEQ ID NO: 36099 - DNA, 248 bp, Homo sapiens
  misc_feature 150, 248: n = A,T,C or G
cggctgatcctggactgggtaccttacatcaatggcaagtttaagaaggataattaattacacaaacccttcacagactgctctggtgcctggtggtgctagctcctcccacctcagcacctgctgcatctggagcagcccaagcctcangatggacaagaggaaacccacagctcagcttcaggcttcttatgtttctgaaaacagcttggatattttaatgcacgttgcattaaacctcactgaan

SEQ ID NO: 36100 - DNA, 146 bp, Homo sapiens
  misc_feature 24: n = A,T,C or G
acactgcccccggttgcctgcctnggccccatgtggaaggcagacgcctgctcgctctgtcacctgtgcctctcagaacaccagcagttaaccttcaagacattccacttgctaaaattatttattttgtaaggagaggttttaat

SEQ ID NO: 36101 - DNA, 118 bp, Homo sapiens
  misc_feature 24: n = A,T,C or G
ctgaccaacatggagaaaccccanctctactaaaaatacgaaattagccgggcgtggtggtacatgcctgtaatcccagctactggggaggccgaggcgggagaatcgcttgaacctt

SEQ ID NO: 36102 - DNA, 425 bp, Homo sapiens
  misc_feature 25: n = A,T,C or G
ctcgaggcaatattaaagtgctganggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatataga

SEQ ID NO: 36103 - DNA, 236 bp, Homo sapiens
agcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaaga

SEQ ID NO: 36104 - DNA, 323 bp, Homo sapiens
  misc_feature 152, 177: n = A,T,C or G
acgctacgccatggtttatggatacaatgctgcctataatcgctacttcaggaagcgccgagggaccaaatgagactgagggaagaaaaaaatctctttttttctggaggctggcacctgattttgtatccccctgtagcagcattactganatgcataggcttatatacaatgctnctttcctgtatattctcttgtctggctgcacccctttttcccgcccccagattgataagtaatgaaagtgcactgcagtgagggtcaaaggagagtcaacatatgtgattgttccataataaacttctggtgtgatactttcatct

SEQ ID NO: 36105 - DNA, 165 bp, Homo sapiens
tgccctaggttgtagagaaactgagtcatttcttgaagaaaagatttgatgtctatattacatattcctaattagttccctattagtttgtcatactgctgatgatgttcctgtctaatagtaacttctggggcatgaagtgggcccggaatgtgcagtactccc

SEQ ID NO: 36106 - DNA, 436 bp, Homo sapiens
  misc_feature 25: n = A,T,C or G
acaggatattataggaatttctttnctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtac

SEQ ID NO: 36107 - DNA, 448 bp, Homo sapiens
  misc_feature 3, 18: n = A,T,C or G
acnatttctgagcgcagnaaagcctttttccctaggagtggggtgcagggaactggagggcaatggttcttatgagagggtgatgatgcttctaagaaaaaagattacacaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttctttttctttcttgaattct

SEQ ID NO: 36108 - DNA, 412 bp, Homo sapiens
  misc_feature 30: n = A,T,C or G
gaagtcccctgggtgttatctctgatggcnttttcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctagatgtcgtctttgactcaagtaccaaataataataatgctatacttaaattacttgtgaaaaacaacacattttaaggattacgtgcttcttggtacaggtttgtgaatgacagtttatcgtcatgctgttagtgtgcattctaaataaatatatattc

SEQ ID NO: 36109 - DNA, 118 bp, Homo sapiens
  misc_feature 7, 25: n = A,T,C or G
agcaagnaagggaaagacagagagngagaaaaaagaggagtcagtcgctcctggggaagggagagagtgagactgggagaaagagaagcacagaaagtgtgtgtaaaacggagtaaag

SEQ ID NO: 36110 - DNA, 373 bp, Homo sapiens
  misc_feature 10: n = A,T,C or G
tacccaaggnaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgaga

SEQ ID NO: 36111 - DNA, 304 bp, Homo sapiens
  misc_feature 24, 25: n = A,T,C or G
taaaacatactctgccgatctaanntacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttg

SEQ ID NO: 36112 - DNA, 216 bp, Homo sapiens
  misc_feature 26: n = A,T,C or G
ataaagcagtagttctcaaactttcntgattttcagggttcctttacattaaaattattgagaacttcaaagagcttttctaaagaggttttgtttgtgtgtgttggtattttagaatgtaaaaatgagagttttaaaaaatatttgtttttattaaagtagcagttatatttacttaaaatttctaaacttatcccatattaacataaatatttg

SEQ ID NO: 36113 - DNA, 307 bp, Homo sapiens
  misc_feature 20, 149: n = A,T,C or G
tggcgtatcacggcctcacngtgcctctcattgtgatgagcgtgttctggggcttcgtcggcttcttggtgccttggttcatccctaagggtcctaaccggggagttatcattaccatgttggtgacctgttcagtttgctgctatctnttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctaga

SEQ ID NO: 36114 - DNA, 270 bp, Homo sapiens
  misc_feature 175, 176: n = A,T,C or G
tgtgaatgaatcattgaacaacctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgnnggaaacagagtgtagagctgtgcaagaaagacagcctttacaaggatgcaatgcagtatgcttctgaatctaaagatactgaattggctgaaga

SEQ ID NO: 36115 - DNA, 132 bp, Homo sapiens
  misc_feature 24: n = A,T,C or G
gagggccacagtgacaaagagagnccacagtctggggagtggcttgaagagaattaaacatgcaacgaggtcagaagaggcaacagagaggtggatcccagctgttagtctaggactcaaaagttatttatt

SEQ ID NO: 36116 - DNA, 292 bp, Homo sapiens
  misc_feature 148: n = A,T,C or G
tatcgatgaaaatgctccagtcactgaaagggctaaactgatttccttgccaactagtaaaaactggaccttcggaccccaggacgtcgatgaactgatcttcatgctgagcgacagccctggggtcatgtgccggccctcccgagtnaagcagatgtttgcctccagagcctgccggaagtcggtgatgattgggactgctcttaacacaagcgagatgaagaaactgatcacccacatgggggagatggaccacccctggaactgtccccatggaaggccaaccatgaga

SEQ ID NO: 36117 - DNA, 248 bp, Homo sapiens
catcttggtcagatttgaactccccaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttg

SEQ ID NO: 36118 - DNA, 230 bp, Homo sapiens
  misc_feature 17: n = A,T,C or G
atgagaaagctgtaatngttcgatttgtaaggctttattaccatgttttttctttttgagatggaatctctctctctgtggctcaggctggagtgcagtggcatgattttggctcactgcgacctccgcctcctgggttcaagtgattctcctgcctcagcctcctgagcagctgggattacaggcatctaccaccatgcccagctaatttttatatttttagtagaaat

SEQ ID NO: 36119 - DNA, 156 bp, Homo sapiens
aatggaatcagttagaaagcgaagaaatcactaaaaaagttacttctttttttccccaccagttataatcttcaaccttactagtttataacagtttaatgtcctatagaaggatcctccactaaagttataattttaagtatagtcatatagaag

SEQ ID NO: 36120 - DNA, 293 bp, Homo sapiens
aggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctggga

SEQ ID NO: 36121 - DNA, 235 bp, Homo sapiens
  misc_feature 5, 10: n = A,T,C or G
gcttngggancagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatga

SEQ ID NO: 36122 - DNA, 243 bp, Homo sapiens
  misc_feature 8, 174: n = A,T,C or G
caaaaagngctttatctctaccatgtactgacagttcttacagttgagatttgttcttttcagctattgcttgtgaaaaaaagcaagactatgtcactctatagaaggctgttaaagtgactcaggcaggaattaattattctgtacctaaggggttaccttgtttaatggganggcattgactttttgaaaatcaagtggactgagtcattgataaaacatttctaagagtggggctagaga

SEQ ID NO: 36123 - DNA, 277 bp, Homo sapiens
tggagttagcattctgaaagtgaagtttgcatactctggtaccatggttcaggtcaggcattctaattgcttctggtttctaaagcatccagttggagaatggataaacaaagaatagatttgcctcctgtgcatggtgaaaatacagaggtccagtcttccagctggaagaaaaccttctgtttgtcctcttgcctgtccagtagctgctagtttcaggatcaaagaaggcaggttgtagtgctaaggagctgtgagcaggaaggtcatcattcac

SEQ ID NO: 36124 - DNA, 153 bp, Homo sapiens
acgaggtgaaaaatattcagtaccttgtttgcatagcatttgtgtaaagactatgatctcatcccaataaaatgatatattaaatcttcagattaatgactggctacagagtaacaaaaaataaagaatttaatgtacagtaaattctctccc

SEQ ID NO: 36125 - DNA, 345 bp, Homo sapiens
  misc_feature 9, 10, 37, 48, 50, 53: n = A,T,C or G
cggttatgnntggcccgggaggggattttggcaaggnatgttagtggntnttngtattttttgactgggcatggtggctcatgcctgtaatcccagcactttgggaggctgaggcgggtggatcacctgaagtcaggagttcaagaccagcctggccaacatggtgaaaccctgtctctactaaaaatacaaaaaattatctgggagtggtggcagacgcctgtaatcccagctactcgggaggctgaggcaggagaatcgcttgaacccaggaagcagaggttgcggtgagccaagattgcatcactgcactccagcctcggcgacaagagtgaaactgtccca

SEQ ID NO: 36126 - DNA, 328 bp, Homo sapiens
  misc_feature 5, 10: n = A,T,C or G
gctcncaagnactttcaggattaagcgatttttggccaagaaacaaaagccaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttt

SEQ ID NO: 36127 - DNA, 289 bp, Homo sapiens
  misc_feature 8, 24: n = A,T,C or G
aagaacanaccaaatatcaaaatnctgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctat

SEQ ID NO: 36128 - DNA, 382 bp, Homo sapiens
  misc_feature 22, 25, 44, 49, 174: n = A,T,C or G
attaccgtcattatttttgtcnttntcctgaagcagcgtttgtngttcnatgaaaatcttttttgttgttcttcaacttcacatacactgccaagagataaaggagagacagggaacaaccacagttggggaaaatcaactaaggttgccctctttgcttacagcaggactganccatgtccacagacactgatgcaaatagcatcagtgccatgaattttcttcctcctgacagatctttcttatctgtatttttgaagcattcaaatttcatttggagctgtacctggaagggacacactgatcctcattctcattccctacaggtgactcgacagtcccccaactcctatgtggtgatcatgaatggctcatgtgtaga

SEQ ID NO: 36129 - DNA, 320 bp, Homo sapiens
  misc_feature 2: n = A,T,C or G
tngttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaaga

SEQ ID NO: 36130 - DNA, 405 bp, Homo sapiens
  misc_feature 3, 5, 29, 30: n = A,T,C or G
agntntggagatgacaatctggctcccannattgccaacgtccagatgaccttcctacgcctgctgtccacggaaggctcccagaacatcacctaccactgcaagaacagcatcgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaac

SEQ ID NO: 36131 - DNA, 323 bp, Homo sapiens
  misc_feature 2, 26: n = A,T,C or G
tnttaatgcactagcctctgtagtgncaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttac

SEQ ID NO: 36132 - DNA, 228 bp, Homo sapiens
  misc_feature 23, 24, 93, 135, 160, 184, 185: n = A,T,C or G
agctcttcatgggcctgaacatnnatttcagtctttgcaaagaatgaagaagtgaattcgctggcatttgtcaccagcactgggtttttgttntttgtttgtttttccgcttaattgcaaagataaaatgcaganacttttgggggtggaaggctcatcntaaaacatgagcatgaaatatatnnggaatagcagaaggttaagaaatatcttatgtataggtaaact

SEQ ID NO: 36133 - DNA, 261 bp, Homo sapiens
  misc_feature 6, 7, 29, 52: n = A,T,C or G
ctccgnngattaaacacttaaatgtatgncatgaaactataaaaataataanaatctacagaaaactcttctggacattgatctagacaaataattcatgactaagagcccaaaagcacaagcaacaaaaacaacaatagacaaataggacttcattacactaaaaaatttctacacagaaaaataactacctaagcaaacagaaaacctgcagaatgggagaaaatataggcaaaccatgcatccaacaggagactaata

SEQ ID NO: 36134 - DNA, 301 bp, Homo sapiens
  misc_feature 23, 24, 27: n = A,T,C or G
atcttagggaagaaaattaagcnnttnaagagatctgtgaaaaaatacagccttgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgtt

SEQ ID NO: 36135 - DNA, 230 bp, Homo sapiens
  misc_feature 148, 218: n = A,T,C or G
agaaataacttttggttgcatgtaaatgttctgaagctaaaagtaaaacttcttcagaaaaatgttggcattttccccttgaaaactgtcaaattctggcagctatgctaatcccatgttcttttacctttaataagtcacatattgnttgcaaactcttaaagttatgcatataaatcttgctcattttgctacttagatctctgaaagagcaaagnagcttataaaga

SEQ ID NO: 36136 - DNA, 132 bp, Homo sapiens
  misc_feature 9, 14, 48, 62: n = A,T,C or G
cgggggaanctacnttttaaagttaattgcttgttttgcctataaccncaaaaataatgaancgatgagaaatacaatgaagaggcaatgtccatctcaaaatactgcttttacaaaagcagaataaaagcg

SEQ ID NO: 36137 - DNA, 325 bp, Homo sapiens
  misc_feature 2, 33: n = A,T,C or G
anaacccccctctcctcacctgctttgagtttnttatctttatcagatattctaaactcaaagggattccctttaaaccaactcaagctgatctttcctatctagcctgctgtttggctgtactcatgggctttggtaatatctcctaaaaatgaggttttggtaatttttcctatgcattgggcaacctgtgatcgtgaccactgtgctggcttgctccagccactgccctggcctcagcatatcagggcagcctgtgctggctgcaatactgtggtgcttgggccactgcctgagaggagccaggtttgtgtgtgtctgcatg

SEQ ID NO: 36138 - DNA, 368 bp, Homo sapiens
  misc_feature 22, 177, 181: n = A,T,C or G
tgaggaagacgcggtcgtaagnttttgtggatttttggtccgcacgctcctgctcctgactcaccgctgttcgctctcgccgaggaacaagtcggtcaggaagcccgcgcgcagcagccatggcttttaaggataccggaaaaacacccgtggagccggaggtggcaattcaccganttcnaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgaga

SEQ ID NO: 36139 - DNA, 318 bp, Homo sapiens
  misc_feature 9, 11, 33, 35, 36, 38, 61, 87: n = A,T,C or G
cagggaagncncggttactagggccgggggagncnncnagtggctagcgcaagaccatttntctccctctgccttcaggcttctgcnatttcattatcatcaagcaggaattatgtcgtaagtcactgaccctaactgcagaccatgaagtaaattatgtaactaggtttttgcttctccagtggtgaccaccccccccatccccgctcacaacttgggttcttctcagcggggcgagctgagaagcggtcatgagcacctggggattttagtaagtgtgtcttcctagaattcgaaggctctctctttctagaggtg

SEQ ID NO: 36140 - DNA, 202 bp, Homo sapiens
  misc_feature 150, 151: n = A,T,C or G
cgcacgcccccgtggcggcgacgacccattcgaacgtctgccctatcaactttcgatggtagtcgccgtgcctaccatggtgaccacgggtgacggggaatcagggttcgattccggagagggagcctgagaaacggctaccacatccanngaaggcagcaggcgcgcaaattacccactcccgacccggggaggtagtgac

SEQ ID NO: 36141 - DNA, 415 bp, Homo sapiens
  misc_feature 20, 146, 147: n = A,T,C or G
gaaatgggcaagttcatganccctgggaaggtggtgcttgtcctggctggacgctactccggacgcaaagctgtcatcgtgaagaacattgatgatggcacctcagatcgcccctacagccatgctctggtggctggaattgaccnntacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttaga

SEQ ID NO: 36142 - DNA, 118 bp, Homo sapiens
agagtccatggcctaccttttccgaaacatcactgtggatgactagctttcacgagggtctcgaccctggacctcctgagggaaacatggaaaaagcagtgccatgagtgatacagtg

SEQ ID NO: 36143 - DNA, 190 bp, Homo sapiens
  misc_feature 1, 43, 44, 45, 172: n = A,T,C or G
ntttcttccaaaattcagtcttattttcagtctacactagctnnnaaatatactgtcctttagatgctttatctaacctcaaatttctaatggatttgtcttagacacttattgccactccttagatagtcattgctatctttgaagttctggacgatacgtgtattacagnaggaactggagacattcc

SEQ ID NO: 36144 - DNA, 287 bp, Homo sapiens
atgaaattgatgtaggtagcttcggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatga

SEQ ID NO: 36145 - DNA, 278 bp, Homo sapiens
  misc_feature 1, 7, 31: n = A,T,C or G
nacaccncgaaagaatctagattgttctttnttttcaatcatttgtaatttctaaacctctcttatgaaaatatgcaaatctaataatagcattctgagtaattgaaacaagtgaaaataaaggacacagtatgtcaaggaagaaccacttttattgggtggaataaagtactactgataaaatttattaggcactcatttcaagaatagaatctcggttgctctgtgtaagaatgaataaacataacaacttacttggctctgtacccagaaattta

SEQ ID NO: 36146 - DNA, 122 bp, Homo sapiens
  misc_feature 5: n = A,T,C or G
ctggnaccctaaagaacagtgactgcaaaggcaaagaaagtaaaaaaggaattggccattagacgttcctgagcatccaagatgaacattttgtagtgcaaaaagacttttgtgaaaagctg

SEQ ID NO: 36147 - DNA, 277 bp, Homo sapiens
  misc_feature 152, 177: n = A,T,C or G
aagctcctgcccctcctaaagcctgaagccaaagcgaaggctttaaaggccaagaaggcagtgttgaaaggtgtccacagccacaaaaagaagaagatccgcacgtcacccaccttccggcggccgaagacactgcgactccggagacagcncaaatatcctcggaagagcgctccnaggagaaacaagcttgaccactatgctatcatcaagtttccgctgaccactgagtctgccatgaagaagatagaagacaacaacacacttgtgttcattg

SEQ ID NO: 36148 - DNA, 224 bp, Homo sapiens
  misc_feature 90, 125, 126, 153, 158, 176, 213: n = A,T,C or G
atagagatacagagacagagaaaaagagaggagagaaagagagacagaggtagagacacagagagagacagagaaaaagagacagagagngatgagagagagaaagagagacagagatagacagnntttcttagacagagaaaaagagagagnggggngaaaggtccacagagatncagacagagagagaaaaagagagaggaaagagagacnccggtagagac

SEQ ID NO: 36149 - DNA, 332 bp, Homo sapiens
  misc_feature 2, 155: n = A,T,C or G
tnttcttattttatataaaataatcccctaatatccaaatgaatctgttaaaatgtttgattccttgggaatggccttaaaaataaatgtaataaagtcagagtggtggtatgaaaacattcctagtgatcatgtagtaaatgtagggttaagcntggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtat

SEQ ID NO: 36150 - DNA, 120 bp, Homo sapiens
ctgtttctcagctgttccactcacaccgtgttaggactctcaaaggtaaaatgtcacaggggcttttcagttgttacagagctcagcagctgtggttgcccctgttctacaccaatttca

SEQ ID NO: 36151 - DNA, 208 bp, Homo sapiens
  misc_feature 22: n = A,T,C or G
atttttatttatttatatttcnttgagacagagtctcgctctgtcgcccaggctgaagttgcagtgagccgagatcacaccactgcactgcagccggggtgacggagtgagactgtcttagatagatagatagatagatagatagatagatagatagacagacagacaagatagatagactctgtctcagaaggaagggagggagaga

SEQ ID NO: 36152 - DNA, 213 bp, Homo sapiens
  misc_feature 126, 153, 212: n = A,T,C or G
tggtgctgaaagaagagcccacagctgacttcatggtgctacaataacctcagaatctacttttcactctcaggagaacccacatgtctaatatttagacatgatggcaaactgggcggaagcaanacctctcctcattcttattgttttatnagggcaatttgtctcaataaaagcccaggaagaagacgaggatgaaggatatggtgaana

SEQ ID NO: 36153 - DNA, 146 bp, Homo sapiens
  misc_feature 4, 48, 140, 146: n = A,T,C or G
tgtnccaccgtgacccctgtctttttctgacctgtgttccctccccgntcatctttcctgttccagagaggtggggctggatgtctccatctctgtctcaacttcatggtgcactgagctgcagcttcttacttccctantgaagn

SEQ ID NO: 36154 - DNA, 302 bp, Homo sapiens
  misc_feature 20, 23, 103, 154, 178: n = A,T,C or G
aaatgctctagtaacaaggngtnccagggccgtgggaacccagaggagggagtgagagttcagaggctgaagaagacttcatagaggagatcatgaagttcangagagcatgaggctgggcagagataaaaccaagggtaagaattaacaagcnggtccaatttccttagatctgtcnctcaaaggcaagccagggagccaaacgtaggaggtcactaggagctaaaaaagcccccagaaaagtcaggtggggtggagggagtataggaatggagatgatttgctaaaaactatagcccagg

SEQ ID NO: 36155 - DNA, 121 bp, Homo sapiens
aacagctcttctcccagaatgttacctagaacaagctgcacaacctggattttttttcaatacgatactgagccatttgctgcatttctttttatattaaatatgtgagtgacaataaaac

SEQ ID NO: 36156 - DNA, 266 bp, Homo sapiens
ctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttg

SEQ ID NO: 36157 - DNA, 192 bp, Homo sapiens
  misc_feature 23: n = A,T,C or G
taaactccatctaaggctaaatnccggcacgagaccgatagtcaacaagtaccgtaagggaaagttgaaaagaactttgaagagagatagtacacatgataaaagggtcagttgccaagacataacaatcctaaaattgcttgcatctaacatagagcttcaaaatacatgaagcaaaaactgattgaactg

SEQ ID NO: 36158 - DNA, 266 bp, Homo sapiens
gcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgta

SEQ ID NO: 36159 - DNA, 219 bp, Homo sapiens
  misc_feature 11, 17, 144, 172, 173: n = A,T,C or G
attaggagatntgcacntcccacaccggtgcagcagtttgccagctaaattcaaaaaactcctggtgccaggaaaaattcagcacattctctgcacaggaaacctttgcaccaaagagagttatgactatctcaagactctggntggtgatgttcatattgtgagaggagannggcgatgagaatctgaattatccagaacagaaagttgtgactgttg

SEQ ID NO: 36160 - DNA, 131 bp, Homo sapiens
  misc_feature 26: n = A,T,C or G
gacaagaaacacgtctggctaggccnaaactatcaatgctggcagccagtttgaatataatgtagaaggagtgacttccaaggaaatggctacccaacttgccttcatgcgcctgctgggccaactatgcc

SEQ ID NO: 36161 - DNA, 221 bp, Homo sapiens
  misc_feature 124, 126, 151, 209, 213: n = A,T,C or G
aacacctctatttctgtgttttcttattttatcgctaaagtttgaaggtcatctcttttagaccatattatgagctatttagatcagttctgtctttcctattgttttaatggccaaatggcanantggttggtatactttttctatcaangggacctgattgagaatgtacccatcagttacattgctgtgtatgttttagatagtangcgngtttaaga

SEQ ID NO: 36162 - DNA, 102 bp, Homo sapiens
attcttaagaagttgattttgacaaattttgccagtgaaaacagtcagaactagctacaaaattttgagattcataaacctagagatgggatttgatgagtc

SEQ ID NO: 36163 - DNA, 256 bp, Homo sapiens
  misc_feature 25, 177, 182: n = A,T,C or G
aatataccaattagttttatataanatcctcataagctattctaatttttgagagaaacacaaaaagttatagattgatagtctgtataatattagacaaaatagtaagctttataaaaagttatttttggtaaatggtaagggatttggggtggaatgtgatgagattaaaatgtngcttnggtataacttcatgtgtatttcaaaatatactgaacgtcaacatgatttgaataaagaaaatgtattttctact

SEQ ID NO: 36164 - DNA, 111 bp, Homo sapiens
catgatgagccctgttcctgctcatcatgaagatccctgcgatacttcaacgccttctgacttccaggtgatgactgggcccccaataaatcccgtctttgggtctctctg

SEQ ID NO: 36165 - DNA, 342 bp, Homo sapiens
acctaaaccatctactctttagtactgttttatatatttttaagcctcatacttgctcattctacggcttttttcactcattattgtataattatatctgaagctctcgttcattaattttagtcctgtgtagcagaattcaattacgggaactaccataatttatctgttctccaggtgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtga

SEQ ID NO: 36166 - DNA, 231 bp, Homo sapiens
  misc_feature 151: n = A,T,C or G
actaataagtggtactatggttacttccttgtgtacatttctcttaaaagtgatattatatctgtttgtatgagaaacccagtaaccaataaaatgaccgcatattcctgactaaacgtagtaaggaaagtgcacactttgtttttacttntccgtttcactctaaaggtagttaagatgaaatttatatgaaagcatttttatcacaaaataaaaaaggtttgccaagct

SEQ ID NO: 36167 - DNA, 255 bp, Homo sapiens
  misc_feature 179: n = A,T,C or G
agatttataggtagaggcgacacacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagnaaaaaatttaacacccatagtaggcctaaaagcagccaccaattaagaaagcgttcaagctcaacacccactacac

SEQ ID NO: 36168 - DNA, 122 bp, Homo sapiens
aattgtattgatcatctcaaagaatcacattttggtttaattgattttctctgttttctgttttctaattcattggtttctgctttatctttattgtttcgttttgcttattatccaaaaag

SEQ ID NO: 36169 - DNA, 289 bp, Homo sapiens
  misc_feature 154: n = A,T,C or G
cgtgctgcgaagtatctcgctagcccctgcgcccgactagcgggcttctgggaacttggcagacgcagcttagagagactcaccagcgagcgtcattgttgtctttctgggaactcattcccatgagatcagaacctcttcgaaaaaagaatanggtagatcctaaaaaagaccaagaagcaaaggagcgcttgaaaaggaagatccgaaaactggaaaaggctactcaagagctaattcctattgaagattttattacccctctaaagttcttggataaagcaagaga

SEQ ID NO: 36170 - DNA, 318 bp, Homo sapiens
  misc_feature 25: n = A,T,C or G
agctgaacatggtacacaattgtgntgaaaagagcttgttttttcggtaggaggtatgcgttgcgtgtgttggttttgaagtaataagtaacgttttatagataaccaccaacctgtgtctggtcagcagtctgatgtcccactactgtcaaggatgcctgtgatgtgtgagcttacctttccattctccttgtatctttcctgatttatctagaaaattaaataaatagggaggtaatgttccaaggaaaggtttcccttccctcactggggatttagtgggggacagtatagactgtcctttaggagataattaga

SEQ ID NO: 36171 - DNA, 276 bp, Homo sapiens
  misc_feature 3, 5, 129, 130, 161, 164: n = A,T,C or G
aancnggaccccccatggcagccatttttatttgattcttaagatccaaaggctgctgaaagagcaattgaataaagttggggattggagaagcttgattttcttgttctctgtgaaatgaaactccannttttttcttccccttcccctcaaaagggggnagnctgctagggggttgtagctgtgtcaaagccgctgggatgccactgctgatcactttaattactacgactaaggaggataaaattaaaagtagcaccattgaagcagtggaag

SEQ ID NO: 36172 - DNA, 148 bp, Homo sapiens
  misc_feature 2, 25: n = A,T,C or G
gnctgggtgacagagcaagactccntctcaaaaaaaaagatgtgttgagcttttaaattcttacttgatacccttgattttgcaggcctgcaagaccccccaaagccagcagtcagcctacttcctgttaacactgtttagagaggtg

SEQ ID NO: 36173 - DNA, 346 bp, Homo sapiens
  misc_feature 16, 23, 150, 175, 177: n = A,T,C or G
tatttttgtttttaangcttccntatttcaatgttagcctcaatttctgaacaccataggtagaatgtaaagcttgtctgatcgttcaaagcatgaaatggatacttatatggaaattctgctcagatagaatgacagtccgtcaaaacngattgtttgcaaaggggaggcatcngngtccttggcaggctgatttctaggtaggaaacgtggtagcctcacttttaatgaacaaatggcctttattaaaaactgagtgactctatatagctgatcagttttttcacctggaagcatttgtttctactttgatatgactgtttttcggacagtttatttgttgaga

SEQ ID NO: 36174 - DNA, 140 bp, Homo sapiens
  misc_feature 13, 15: n = A,T,C or G
cggccggtactgnanaaagccacaagtggaggcgccgctctagcggccgggactctgaactatggcggctagtgatacagagcgagatggactagccccagaaaagacatcaccagatagagataagaaaaaagagcagt

SEQ ID NO: 36175 - DNA, 438 bp, Homo sapiens
cagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccctaagcaagccagtgggcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattg

SEQ ID NO: 36176 - DNA, 140 bp, Homo sapiens; identical to SEQ ID NO: 33419

SEQ ID NO: 36177 - DNA, 117 bp, Homo sapiens
gtagtactcttttaaaaaattctgaatctgaccgccattgtttattggatttgaacacttggatgctttggtggtacatgtcttagactcaaatttatcttccagattgcaaaggtt

SEQ ID NO: 36178 - DNA, 203 bp, Homo sapiens
  misc_feature 16: n = A,T,C or G
gttcctccttttcttnccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttag

SEQ ID NO: 36179 - DNA, 116 bp, Homo sapiens
  misc_feature 2, 76, 78, 108: n = A,T,C or G
gncccactgtgcaacattagacagttcaacgagcacagcaaagtcaactagggaaacccaggcaattgaactcagntntgcaccaagcggacctaatagacatctacngaactctc

SEQ ID NO: 36180 - DNA, 297 bp, Homo sapiens
  misc_feature 3, 10, 39: n = A,T,C or G
ctntagtgtnatggctaggggatgaacaggttattgagnaatactggagagttcttccgagaaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcaagtgcctggccatgttcctacggctcaggtcctccctacaagacctaccactcacccatgcctatgccactccatctg

SEQ ID NO: 36181 - DNA, 465 bp, Homo sapiens
  misc_feature 12: n = A,T,C or G
gactttagaatnatttgttgatatccacaaaataacttacttggattgtattgggattgtgttatacctctagatcatgttgggaagaattgacaccttaaaaataccaagttatcatattcatgaacataaaatgtctccctatttatgagtatctttaatgattcctggtgagttttgtagttttccacatatagatcttaaacatactttgttacatttatacctactatttcttttttgatgtaaaaatttaaatgtaaatataaattatattgtctttttaattttatatttcaattgtttgttgctgaaatatgggaaattgactgtagtatattccccttgcatcctttggcctttcaggactcactattagctctagtagtttttactgattccttgaaattttctacgtagacaatcatgtcatctgcaaacaaagacagttgtacttattccttt

SEQ ID NO: 36182 - DNA, 462 bp, Homo sapiens
gagtgtgtttacaatcatttgatctggctaaactattttaatgttaatgaaattttaaaattttggaggaaaaaatttaaaaactacacaggtgcacaaagaaataaaaatcacctgctttttcactatgtagagaccattgtctactatttctcaattctgtgttacatctgtatgttaataactgtaggattagggactgagtactgtttttaacctgcttttaaaaaatttacatctacattctttcccatctaaatagtgaggaagagtatcagaattttgtaggcttgtggtgatggttaaattagataatattaatgttgggtacttaacataatatatggctcttaatactctccagatttcagatatagtctgttttaccattactgcctttttatcaaacctattctcaaaaaagtgagaaaagtgctgagattacaggcgtgagccaccatg

SEQ ID NO: 36183 - DNA, 467 bp, Homo sapiens
gcttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagcttggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggca

SEQ ID NO: 36184 - DNA, 244 bp, Homo sapiens
atcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatggtaatggttttaaaatatgttcctgattgtacatattgtaaaataaacatgtttttt

SEQ ID NO: 36185 - DNA, 466 bp, Homo sapiens
  misc_feature 124, 460: n = A,T,C or G
attttacggctgtggtatcggcagtttagggtatggagcaagtaatattgtgtgttttctttttttctttctttccttccatgtagcatctgcataccaaaggacttattctatgaaatacttnaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagntttcta

SEQ ID NO: 36186 - DNA, 120 bp, Homo sapiens
atttaggttatttgttgagactcattggtactgactggcaagtattctgctttaaagtatcatgtattaaaaatgtttagacagcatgtgttttaaagtggattaaaaaaaattggggcc

SEQ ID NO: 36187 - DNA, 440 bp, Homo sapiens
  misc_feature 269, 370, 387, 419, 428, 439: n = A,T,C or G
agggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctccgctgttgacaatggctctctggccaacacgcctcatctgagggagcttcacttggacaacaacaagcttaccagagtacctggngggctggcagagcataagtacatccagggtgtctaccttcataacaacaatatctctgtagttgggatcaagtgacttctgcccacctggacacaacaccnaaaaggcttcttattcngggggggagtcttttcagcaacccgggccagnctgggaganacagccctccnc

SEQ ID NO: 36188 - DNA, 320 bp, Homo sapiens
  misc_feature 318, 319: n = A,T,C or G
atacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcacttttgtggatatagttataatctgatgggcctggctgggagtggaagaagggaagccttttgcaaatagtagagtgtcagttgcaggtgccaatgactaactttttgaattctatgttggcattaacaataaagcattttgcgnnc

SEQ ID NO: 36189 - DNA, 472 bp, Homo sapiens
atgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattga

SEQ ID NO: 36190 - DNA, 459 bp, Homo sapiens
  misc_feature 34: n = A,T,C or G
agaggccgttataatttaatattggcctaatttnaatattgttgtgtctcagggaatagggaagcctgaggagagggacagagatggggaacagccagtaggtaaagcactcagaacacacccatctatggattatgtttgtcttgtatgggtgtggttcacggtgtcctacaatagtaacatctgagatcactgataacagataatcgtaacagatataatgataaagtattacaagaattaccaaatgtgacaggcctgaatgagcacatgctgttggataaatgatgaatggagacttgttcaaggtatggttgccacaaaccttgaatttgtaaaaacaaacaataacaaaaacaaccacaatatctgtgaagtgcaataaagtgaggtatgtctctattcagtgatgatgggtttttttaatcccagaataagctgtctcctgtttctcatgat

SEQ ID NO: 36191 - DNA, 465 bp, Homo sapiens
ggctcacatagttatttgcaaaaagaacttctaagcatgaaattgagcataaaattgcctaggagtaattcagtttgcttaatatgtttgagagaaaggttaatatattcagtcagacagccttttgtttttggataaagacgttctcatttttcagcatggcatgagggaaatagcctggaatactctcagtaaatcagattttccttgaaaagagtggccctacctctcatagacttcaacggcagtggtttaatatggttcccaaattctgaagtcttctgaaatttgttagacaaagcaagacttaacgatcacagcatgatgcaaatactaattttccgagtaaaacacaataaaagattgaccgtttctctctcatgtcatttacgtatgtctatgactgtgagaactaaagtggccgtatttacagtaaggtaactattgttaatgctgacgtattct

SEQ ID NO: 36192 - DNA, 473 bp, Homo sapiens
ccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaaca

SEQ ID NO: 36193 - DNA, 466 bp, Homo sapiens
gctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcag

SEQ ID NO: 36194 - DNA, 500 bp, Homo sapiens
  misc_feature 5, 17, 38: n = A,T,C or G
tcccngggaattcggcnttacggccgggggatgcctgntggaaaaatcaaggagagccatcatctgggatgcagtgccagctcagagagcagacaattatgctcagagatatgagtggtcccagagttgttcagacacctgtgaaaccctgggactgactatgaaattgtacctgttgatgagcaattctaaaagtcatgcactctttgactttcacacaatttcaggctaaaccaaggccctacgattagtaggtgctcaataaatgtcagtgactgatcaaaaagatttgggtataactgatttcaacacagaagtgggaacatgttagggtcaaatcccaaagatttgacaaaacaataacctcccagcctgaccttctagatttatcattgcaatggataacctatagtgccctttgtttaaaaaaaattgactgtgtttttattagaacagttattcatacttcttgatgaaaatttggaaagcacagaaacata

SEQ ID NO: 36195 - DNA, 462 bp, Homo sapiens
  misc_feature 131, 298, 435, 438: n = A,T,C or G
ggcgtcgtagtctcctgcagcgtctggggtttccgttgcagtcctcggaaccaggacctcggcgtggcctagcgagttatggcgacgaaggccgtgtgcgtgcctgaagggcgacggcccagtgcagggcntcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggngggccaaaggatgaagagaggcatgttggagacttgggcaatgtgactgctgacaaagatggtgtggccgatgtgtctattgaagattctgtgatctcactctcaggagaccattgcatcattggccgcacactggnggnccatgaaaaagcagatgacttggc

SEQ ID NO: 36196 - DNA, 346 bp, Homo sapiens
gttactatttctatgaaagattatttagagatctaggtgctgtggcttgtaatcccagccatcccagaggctgaggtggaaggattgctggatggcagatttggaggctgaggaaggatagctggagattaagagttggagaccagtctgggcaacataggaagaccccatctcttaaaacaaaacaaaacaaaacaaaacaagtgttgcgtgtgtctgtagtcctacctacttgggaggctgaggctggaggatcgcttgagcccgggagtttgagattgcagtgagctgtgattaaaccactgcactctagcatgggtggtagagcaagaccttgtttctttac

SEQ ID NO: 36197 - DNA, 172 bp, Homo sapiens
cagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggccc

SEQ ID NO: 36198 - DNA, 363 bp, Homo sapiens
caagcacatccttgctaatttcaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcat

SEQ ID NO: 36199 - DNA, 464 bp, Homo sapiens
  misc_feature 291, 294, 307, 337, 344, 371, 387, 417, 452, 458: n = A,T,C or G
atctgaacaaagtcttatcgcacacacatgttttctctgtaaggtacatcagagctttcatttgcttaggaacaatagggctttagtactatgcttgaggccattttaaacagtaaaatcaccaacaaaaagtacaaacatatcaaaaccgtggcactaaataaactgtgagaacagttgtttacagcatgagagctaaaacaagaaggcaaagtatttacttgtttgacctaggctaggaacatgtgtatggagtgactcaattttttttatttatttattttttttttngcnggactgcacttgngcccaaatgactgcaaaagcaatgcaagtntgatttnggggttacaaataaattttagggagtnggcaaattagcaaatntggaatccacaaataatgaggatagatggngtcatgcaaagatcaatcaaaggaaagcagatttnttaatntcagat

SEQ ID NO: 36200 - DNA, 443 bp, Homo sapiens
  misc_feature 2: n = A,T,C or G
anttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaat

SEQ ID NO: 36201 - DNA, 369 bp, Homo sapiens
catgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattccttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgc

SEQ ID NO: 36202 - DNA, 333 bp, Homo sapiens
ggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatga

SEQ ID NO: 36203 - DNA, 412 bp, Homo sapiens
  misc_feature 7: n = A,T,C or G
ggtgtgngatccataggaaagcatatgcagccaaccgagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 36204 - DNA, 211 bp, Homo sapiens
ggcaacaaaagctctgtagggctgcagacatttaaagttcacataatcatctgtaagacgttatgtattttgtggaaatactagaatttttttcctgattttgccattatatggatttgctattttttgattaatgcaaaagtatatgactttgttttttatgtgatacaccataaatattaaagtgttgaatactaacagtgctgactac

SEQ ID NO: 36205 - DNA, 460 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatt

SEQ ID NO: 36206 - DNA, 468 bp, Homo sapiens
  misc_feature 20: n = A,T,C or G
gggatcggagcggatcggancacaccggaacaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatc

SEQ ID NO: 36207 - DNA, 468 bp, Homo sapiens
  misc_feature 13: n = A,T,C or G
ggctgtctctagnactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatg

SEQ ID NO: 36208 - DNA, 119 bp, Homo sapiens
ggattaatataccaataactactgtggatgaaacagggctggccttttaagcaaaggatttaaattaagcctgttcttaaatggttccactatctttgatgggtctaaggtggaaaagc

SEQ ID NO: 36209 - DNA, 462 bp, Homo sapiens
ggggtatcattaacagatcagcatgtccagctccccatggcaatgactgcagagaatcttgctgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagcctgatggtgctggagctgttatcatagctagtgaagatgctgttaagaaacataacttcacaccactggcaagaattgtgggctactttgtatctggatgtgatccctctatcatgggtattggtcctgtccctgctatcagtgg

SEQ ID NO: 36210 - DNA, 465 bp, Homo sapiens
aatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagt

SEQ ID NO: 36211 - DNA, 138 bp, Homo sapiens
ggggctcacacacatctggatttgaagaagaatcgtgggtttcaagaactctgtggtctcttaagcattggtattccacagctacacttccctgatactttgcactcagtaatgacagaataaatatttgtagaattg

SEQ ID NO: 36212 - DNA, 465 bp, Homo sapiens
gtggacggccgatgctgcgcgccccagctgaccggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgccggatggacactaatgcagccacgattggagaatactttgcttcatagtattggagcacatgttactgcttcattttggagcttgtggagttgat

SEQ ID NO: 36213 - DNA, 121 bp, Homo sapiens
  misc_feature 36, 39: n = A,T,C or G
tttttctgggggtaggatgaagagaaggcacacagnagnattctggatctcctgctgccttttctggagtttgtaaaattgttcctgaatacaagcctatgcgtgaaaaaaaaaaaaaagg

SEQ ID NO: 36214 - DNA, 465 bp, Homo sapiens
  misc_feature 219, 274: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaac

SEQ ID NO: 36215 - DNA, 467 bp, Homo sapiens
atctggaagggacatgtaataagcatagagagactgagaacaagctatttattagaaaactaaggtgtgtttgatttattagatcctgagatatgtcaggcatatctaatggcagaatctaatatacagacaaaataatattagtattcttttgtatgcaaccacgcaggtaagttttgttcactgtcaaaatttgtttcattctgtggctattctatttaacatgattctagcatcagctgagtgagaccttattatctctaatttgccagactcacaaggtttaacattttattatttgactgaaagtaattctactgcataacagttttattgaaaaatattttacccaaaagagaaagatatcttatacatttcagtttggcttctgtgatttacaaaattatgccaaatttattgtaagcaaggattgatttttacaaaacaacttaccaggaggcttcagc

SEQ ID NO: 36216 - DNA, 465 bp, Homo sapiens
atgggcaaatccaacaggcagaaaatcggtaaggacatagatgtacagcattaacaaatcatttggatgtaatcgacgtatagactactttatctgacaatagcgtattacacagcctttcaagctcacatagaaggttcaccaagatagattacatctgaacaataaaacacaccttaacaaattaaaaaaaatagaaaccatgcattgtctgctatcagagtacaatggaattacactaggtcgataacagaaagatagctggaaaaatcccaaaatacttggacgttaaataacacatttctaaattacccatgggtcaaagaaaatatctcaagagaaattaaaaatatatttttgaactgaatttaaaagaaaatacagtttatcaaaatttgtgggaggcaacaaaagcaatttatgagggaaatttacagcatcgaatgaatgtgttaggaaaagaag

SEQ ID NO: 36217 - DNA, 138 bp, Homo sapiens
agataagtgtaattttctctataggagaccacgttgctacatctgttaatgcctgtcagtgatcaaaagaaacttaaaaagtggaatggggtatggcttttggtacctgaaaataaatgctttaataattgtaagcct

SEQ ID NO: 36218 - DNA, 465 bp, Homo sapiens
  misc_feature 18: n = A,T,C or G
atcgtgaagggccccagnagaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacacttgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcctgttcagtatctcaagcccagaaagatgaattaatccttgaaggaaatgacattgagcttgtttcaaattcagcggctttgattcagcaagccacaacagttaaaaacaaggatatcaggaaatttttggatggtatcta

SEQ ID NO: 36219 - DNA, 464 bp, Homo sapiens
gcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctccttcacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaag

SEQ ID NO: 36220 - DNA, 233 bp, Homo sapiens
  misc_feature 37, 41, 50, 52, 195: n = A,T,C or G
ataacagagcccactttgaaacagtttcctgttaaancatnttataaatngnggataatctgagccatgggagatgatgtaattctacatgacagagttcacaagaaagaggatagctcctcagatagaataagattaagactcttgagagagatgcattggggcttttatggcactttacctttataggcgtanctgactctcagttcttcatattaatgttgtagtgttgt

SEQ ID NO: 36221 - DNA, 350 bp, Homo sapiens
  misc_feature 322, 335: n = A,T,C or G
attgaccacctacattgtatcttttttgtttttctttaaataacatactactattagttgaaagtatgtgagcatttgtctacgggagtgttttgactttaccagagtaccttttcaatttctgtctttgttgtatcttcattttactgttaattctgcaggggttctcgtttatctttgaattgtaattcttattgaaagtaaaataaaaaaattatgcataagtatataatttgaccacttttccaaatttctataatatgggcttttatagctttttaaaaaagcaggaatagtttctttttaaaaaaaaaatacattngcattttcaaagnggctgtagtttgaac

SEQ ID NO: 36222 - DNA, 273 bp, Homo sapiens
gatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacaccca

SEQ ID NO: 36223 - DNA, 214 bp, Homo sapiens
gagaacaaatctctttgctagtcaggtgcttcctagttcactgtttaaaagaaatgaagaaggactttatcaaattgtcatgtgcccgaagattaaaaatatttttgctaatagaccattacacaaatgttgacatataacatagaaggaattcaaagaactgaattacattgctataataaaacactctcaattccttcaacttacatctgtg

SEQ ID NO: 36224 - DNA, 203 bp, Homo sapiens
gtatatgtgatggcagaggggaacgtgctagtgtggtaggaaatactatagctggcagagaaagaataagatggagtgaaggttgggaggagatgagaacataggtgatggggttaatctttgaaaggaggagaggcaaactcccagttggtccagagggaaggtgagcatgagggatgagcagagggaaggaagaattactg

SEQ ID NO: 36225 - DNA, 178 bp, Homo sapiens
  misc_feature 109: n = A,T,C or G
ctggtcccagtgccctgttccatacataaaaggagaggggttgttggctgggcacggtggctcatgcctgtaatctcagcactttgggaggccaacgccgaggcgggcnggatcatgaggtcaggagatcgagaccatcctgtttaacacggggaaaccccgtctctactaaaaatgc

SEQ ID NO: 36226 - DNA, 463 bp, Homo sapiens
gttttatttatggaggtttttccagagtctttcttcctgtcactaatttcttttcttcatttatttttcttaactgtttttaaagttctagaatgtttgttaaagcaaactatttatttttgtgaattttttcctggatcgcattttaagaaactagtccaatttatatgtaagcattaaaaatgagtcttgatgaatttatggacatttattaggcatttgctatgttctaggtactgtgttaggtgctagtgacacaaaatgtgtgtaagacaaggccttaaactcagaaatttaccagccggcaataacacagcaaatctgtttaatcctagcattagtcatagtatgaattggtgggttttttccaattatttttatttattttatttttttgacacaaggttttgctctgttgtccagactggagtgcagtggcacaatcatggctcactgcagcctc

SEQ ID NO: 36227 - DNA, 467 bp, Homo sapiens
ctacccaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgaagtgtccctttatatttaaatttgaaagttgtaagcactgatgttaatgtgattgatccgcatgggcatatgtaaaatgtccttttctg

SEQ ID NO: 36228 - DNA, 375 bp, Homo sapiens
aatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagccccggagttccgggagaacgaacaaaagcgcatcctgggcttgctggagaacttctagaggcaccttggccctgcgcatcatggactctctcagcttccctcccaggatcagtttctacacaactctgtgtggcttttggacaaattaaagctagttttaga

SEQ ID NO: 36229 - DNA, 490 bp, Homo sapiens
  misc_feature 193: n = A,T,C or G
gaaatgtttccatcagccttctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttnaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgact

SEQ ID NO: 36230 - DNA, 468 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataattttgaaggcgatcttttaaaaagagattaaaccg

SEQ ID NO: 36231 - DNA, 201 bp, Homo sapiens
  misc_feature 1, 2, 130: n = A,T,C or G
nnagctcaacacccactacctaaaaaatcccaaacatataactgaactcctcacacccaattggaccaatctatcaccctatagaagaactaatgttagtataagtaacatgaaaacattctcctccgcntaagcctgcgtcagattaaaacactgaactgacaattaacagcccaatatctacaatcaaccaacaagtca

SEQ ID NO: 36232 - DNA, 472 bp, Homo sapiens
ggtaccataggaagataaaattggaaaggtagtgtattaggccattctcatattgttataaatacctgagactggctaatttataaagaaaagaggtttcattgactcatggttctccacgctgtacaggaagcatggcagtatttgtttctgggtaggcctcagggaggtttacctgatggtggaaggcaaagtgggagcagacatcttacacggcaggagcaggactgagagagagtttggcggggggctatacaatttgaacagccagatctcactagaactcactcaccatcatgagaacagcaccaacagggaaatcagtccctgtgatccaatcacctcccaccaggtcctacctccaatgtgggtattacaatttgacttgagatttgggcagaggcacagatccaaaccatatcagatagtgagatcaagttgtggatagtcttgaaatgtaacttcagagatg

SEQ ID NO: 36233 - DNA, 236 bp, Homo sapiens
aaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaac

SEQ ID NO: 36234 - DNA, 482 bp, Homo sapiens
atcctaaaaggtttacatacaagcagaacacaatgcatacaaattaaagacagatgttttactttaatacccccaaaatactgccattttttctgcttttaattcctgatctaagtacgtaagatattttcaggctgcactgtcagtacttcagcaacagtaaatgtaaattaatataataatactcttttcttttctttttgaaacagggcctcgctgtgtcactcaggctggagtgcagtggtacgatcacagctcactgcggcctcaacctcctaggctccagcaatcctctcacctcggcctcccaagtagtcaggactataggcacatgccaccacacaaggcttttttttatatgtattttttttatttttgagagtgcagtggtgtgattttggctcactgcagcctcagctactcaggatgctgaggcaggagaatcgcttgaacccaggaggcggaggttgtggtgagccaag

SEQ ID NO: 36235 - DNA, 395 bp, Homo sapiens
gggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacttggatttttccaaacaacttttatttcctcagagtcttccttaatcctatggaacaagaagctgccactgaatagggcccagtataggggcttgcttttctactccctccccccaatataaaaatatagaccttt

SEQ ID NO: 36236 - DNA, 138 bp, Homo sapiens
  misc_feature 136, 138: n = A,T,C or G
aatgaaaagtagccctttatcaatacagtgctgcaatttctggatatcagctacactttgtttttaagtttgtttttgacatgtttatttggcaaattttataatgaagttttaagttgaaaataaaatgtagcgncn

SEQ ID NO: 36237 - DNA, 470 bp, Homo sapiens
ggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttac

SEQ ID NO: 36238 - DNA, 473 bp, Homo sapiens
  misc_feature 6: n = A,T,C or G
attttnagtttgtgaaaaaactgcttacatgtaatggtgtttatttaaaccctgctccaggtaagctttgaaagtagcttcttctaataaagaatagtttttatttggcttctaggataccttacagggcatcaaatgtgcttcacctttttcttcagttttcttttattttttcatagaatctttaacctcattttatatgaatgtgttggcttttttggtatagttattttaaaatgaaaaaattatgatatctgtacctttgaacagtgattcttaatatatggaaatatagaaaagcatttgttgtagtaattactattttttactcaagaattagtttgaaatatgggttagggaaggggtaagataatcactaagaataactaagattttttaacatagagtttgaagataaaaatgtttttaaccatatatatactttttatttaaagggcaggattatttgttgc

SEQ ID NO: 36239 - DNA, 463 bp, Homo sapiens
  misc_feature 143: n = A,T,C or G
ggacccggaagttgtacttgcaactgcggctttccttctcccacaatccttcgcgctcttcccttccaacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcgggctgtccagaaaacgtaatgaggatgaagattcaccaaataagctatatacttttggttacctatgtacctgttaccacttttcaaaaatctacagacagtcaatgtggatgagaact

SEQ ID NO: 36240 - DNA, 467 bp, Homo sapiens
caccgtgttagccaggatggtctcgatctcctgaccttgtgatctgcccgcctcggcctcccaaagtgctgggattacaggcttgagccactgcctccagcctatcctgatttctactgtcatgcctcacatcagtcctttttcttttttttgagacagagtctcgctctgtggcccaggctagactgcagtggcacgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagt

SEQ ID NO: 36241 - DNA, 447 bp, Homo sapiens
aatcttcattctttattgttgtcgttgttgttgttgctgtttttgtttgtttaatccctgcctctttgtagtgccctcatctctcgtttctttgaactacaactggtccccagtgcctgtcatggtaatctggtagaccatttctatcacgaacaactctcatggctgaggcccccggttgtgtgtgttgtgtgcgtgtgtatttggagaaagaccattcactgaaaggaacggggccagtccttactccgtggaactcagacctctcctcttcgcccacaatcccctcagaaatgctagagggaatgtctactgagtcgaaagtcctacagatttgtctctgttccttcccattgcaaaaccaaatcgctttcatgtttctgggacccactctttcttcacccagacataaaaagagaaaacgtgtgcagtgacgaccagcggaac

SEQ ID NO: 36242 - DNA, 180 bp, Homo sapiens
aactggtgtgagtaaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 36243 - DNA, 322 bp, Homo sapiens
  misc_feature 20: n = A,T,C or G
ggattatctagagaataatntatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtta

SEQ ID NO: 36244 - DNA, 342 bp, Homo sapiens
atgaatgaatgagtcatgggcagtggctcatgggttgcttggtcagtcaggaacttgagcaaaataaagttggaaaactgggggatggaagagagaggtatgcacagacctcttgacatgggcagagcttcagaagatggtggttgcaggtttccccaaatagagaacatcaataaaaaggtagaaattttacaaagagaccagataaaaagtttggagctgaaaagtgcaataactgaaatgaaaaattcactagaggggctccagagcaaatttcaccatgcagaatggggaatcagcaagcttgaagataagacaattgaaattctctagttcagtagc

SEQ ID NO: 36245 - DNA, 472 bp, Homo sapiens; identical to SEQ ID NO: 27132

SEQ ID NO: 36246 - DNA, 296 bp, Homo sapiens
  misc_feature 14: n = A,T,C or G
gtaataggcaaggntgggcaccgtggctcttgcctgtagtctcagcacgctgggaggccaaggcaggaagattgcttgagcccaggagttcaagaccagcctgggcaacactgcaagaacctatctctgcaaaaaataaaattagctagatatggtggcgtgtgccttgtagtcccagctacttggaaggcttgaggcaaggaggattgcttgagcctaggaggttgaggttacagtgacctatgattgcatcactgcactccagcctgggcaacggagctgagaccctgcctctt

SEQ ID NO: 36247 - DNA, 435 bp, Homo sapiens
atcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctatta

SEQ ID NO: 36248 - DNA, 203 bp, Homo sapiens
  misc_feature 194: n = A,T,C or G
gaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccntgacttaac

SEQ ID NO: 36249 - DNA, 131 bp, Homo sapiens
ctgctaaggccattggacacagaatccgagtgatgctgtacccctcaaggatttaaactaacgaaaaatcaataaataaatgtggatttgtgctcttgtatttttaagtggattaaaaaacttactacctt

SEQ ID NO: 36250 - DNA, 284 bp, Homo sapiens
  misc_feature 11: n = A,T,C or G
atagtggagancttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggattataggcgtgaaccaccgcgcctgtcccattgttgtgtaattttaataattagttttttaagtacttgattttatgggcacatttttgtgggatgactggagttaatcaaataaagcttgtcatgtgtac

SEQ ID NO: 36251 - DNA, 471 bp, Homo sapiens
ggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactggaagaagttcctagtttacagctcttttacattacatttacaatagtgcttgtacaagctt

SEQ ID NO: 36252 - DNA, 481 bp, Homo sapiens
tatggccgggggagtttgaacccgttttggttgcatttcctttttggagaacttaattaacgtgagattggcaattgaaatgcaggtgcagttttctgttaatgtcatgctgttgtttaggtaataagaagtattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttggtttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgataaat

SEQ ID NO: 36253 - DNA, 103 bp, Homo sapiens
tatggccgggattcagtctggtaaatgcctgcctggcgctatgatatcattctcaatgcaggttttatggaaaaactaaaagaatatgttgttagatgatgtt

SEQ ID NO: 36254 - DNA, 336 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 36255 - DNA, 473 bp, Homo sapiens
ggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataactgaaatcaaagatggagactttaagaacctgaagaaccttcacgcattgattcttgtc

SEQ ID NO: 36256 - DNA, 462 bp, Homo sapiens
  misc_feature 458: n = A,T,C or G
ggtagtagcctgaggttcctttatgtggccctatagctgttactgaaggaagtagcctacgtccacgcctacaactgaagtctcttgacaaacacctcacccctgcctccgggatgaaagggggtaacctagacctgaatgggcttgaccattctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatgggagaatgctttcttctgatactatttacttagaggcagttttaatataaatcatttcaattatatctncttc

SEQ ID NO: 36257 - DNA, 380 bp, Homo sapiens
  misc_feature 349, 377: n = A,T,C or G
gaaaggtgggactgaattgcgtggatcttattggccactggtagctgaaagagtgaccgtatcagaaactgaagtctcaactaacagacagtggtagatgagaggtgctgtagtacgtgaattcagggaattaggttggttactctaccggcatcttccatccttggtcactggagtgcctggaatcaggctggctctaattctgcccatcctcacacccaactgctctgaacacggagtagactccattcctggaaccagcctaagccaacagaagagaaaaaggaagcatgctgattttagtgtggggtggaactgaacctttgccaaagaaaaaaagggaggaatnccaagagggaatggggatttagcaaaancct

SEQ ID NO: 36258 - DNA, 217 bp, Homo sapiens
  misc_feature 182, 192, 217: n = A,T,C or G
aggaaggccaaaccgaggaattatctctgacagaagggaagaaatgatcgtggtggccttttcagaccctacgggaaaggtctctacccaaccggtgaacgtgtctacctagaccaagaggattttagtttcctgacttgggcatgtgagtaaagtcaatttgccagtcctgggcaagagcnaatccctgancttgatttttagggaaagggagggn

SEQ ID NO: 36259 - DNA, 148 bp, Homo sapiens
aaaatttgttagttacaacttttagtttgggtttccctctccttgctgtaccaccatcttctccatcctgattacttcaagaaattgcactatagttgaacttttcttgagctcttggaattctggatcaaatttaacaagataaccc

SEQ ID NO: 36260 - DNA, 469 bp, Homo sapiens
  misc_feature 413: n = A,T,C or G
gtaacttgccatggttagcacatctttgatgtcaactgactgtcccttgcagagagggatcttttatcattcattctctgtcctttttgcagcttacagttttccttctgagcttacacagaaggaagcttcctttaactgctttaaagatttctttttgacagttcgatggctgcatctttttagtagctcttcaataaatgaatacatttgatataaatcaaatgctgaagggttttttgtaaagtagaattttccccattgaatgattttagagctgtttgagaaagctctagctttttgcccctaagtatgtctgtcactcttaacatgttaagttgaattgattttaatttggctatattttcattgtgtgtgtatgtgtgtgtgcgtatgtatgtgttttttcctanggtacacttaaaagtacttcagattgtctgacagcaggaactgagagaagcagtcc

SEQ ID NO: 36261 - DNA, 472 bp, Homo sapiens
  misc_feature 134: n = A,T,C or G
gggctgagtcactttgcctctctgggctctcctgtccccgctgtgaagtgtatgtagaccctcctcttcctcatagggttattgtgaagatcagagtgtctggaaaaccctggaagggcggctggaggtatcangtcccccctgcccgttctctgggcctccattgccacattcatgaaattagaaaagctcgacctgaaaactccttctggccgggcatgggggttcacacctgtaatcccagcactggcaggctgaggccagtggatcattttgaggtcaggagttcaagaccagcctggccaacatggtgaaaccccatctccactaaaaatacaaaaattagctgggtgggtagtggcacgcgactgtaatcccagctactcaggaggctgagacaggagaatcactcgagcctgggaggtggtgggttgtgggtgagcccgagattgtaccactacactccagtctg

SEQ ID NO: 36262 - DNA, 454 bp, Homo sapiens
atctctcaaaacatattactttgtcttttaatcttctacttttaactaataaaataagtggattttgtattttaagatccagaaatacttaacacgtgaatattttgctaaaaaagcatatataactattttaaatatccatttatcttttgcatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatgggtaatactattaagcaagaatgcagtacagaattggatacagtacggatttgtccaaataaattcaataaaaacctg

SEQ ID NO: 36263 - DNA, 229 bp, Homo sapiens
gtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttc

SEQ ID NO: 36264 - DNA, 472 bp, Homo sapiens; identical to SEQ ID NO: 27132

SEQ ID NO: 36265 - DNA, 244 bp, Homo sapiens
  misc_feature 4, 243, 244: n = A,T,C or G
aatnaagcttcttgaagaaaaacaaagctgagggacatatcctaccaaatatccagactttataaaagctgcagtgattaagacaatgcagtgttgccaaaaagatagacaaataggctgattggagggaacagtcttcaaacaaactgcacatcagtagtcacttaatttatgacacatgacaaagagaaaagatggccttttcagaaaaggtactgggagaactgaactctccataaggcnn

SEQ ID NO: 36266 - DNA, 264 bp, Homo sapiens
ggagtactcagctgtgtcaaatgttgatgagacattgattctgagaattgactattgattttggcaacatgaaagtcattggcaacccagagacaaaagcctgaatggattgtttcataaaagaatggacagtgaagaagtgaaggtagtaagtctttctatgagtttagttgtaaaaggagtatagaaaaataagagtgttagctagagaggcaattgggataaatatatggtgatttttgtcggttaataaaattaatttct

SEQ ID NO: 36267 - DNA, 469 bp, Homo sapiens
gactctaaacctgttttatagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggccgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaaatttttggagccattcttatgatgctcttgattt

SEQ ID NO: 36268 - DNA, 472 bp, Homo sapiens
tgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttga

SEQ ID NO: 36269 - DNA, 471 bp, Homo sapiens
ggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgaggggggggattttttgctcttgtcctgagaaata

SEQ ID NO: 36270 - DNA, 124 bp, Homo sapiens
ctgctttctgaattctggaaaatatttctctgtggatgaaaatgggtcaggattctgaactttgccacacacacacaaacacacacatacatgcacgcacgcacgcacacacacacactatttt

SEQ ID NO: 36271 - DNA, 262 bp, Homo sapiens
actcaatttccctttaataaagggggtgggggccaggtgcagtggctgacctcatgatctgcctggcttgacctcccaaagtgttgggattacaggcatgagccgttgcacctggccagggtgtgtcttattgaaattgaacaaaatacctaatttctagagcgtataagagaagtttaaaatgctttattggatgtgttgttttgacagcaaaatatctactcagaatcctatagctatttcaaaatccaagtaacttaga

SEQ ID NO: 36272 - DNA, 471 bp, Homo sapiens
  misc_feature 40: n = A,T,C or G
ggagcacctgacggagaaaatgaagaccaccatccagagnaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagc

SEQ ID NO: 36273 - DNA, 363 bp, Homo sapiens
  misc_feature 333: n = A,T,C or G
gtgttataggctggatagccacatccctggtctctactcattcgatgcccagagtacctcacgctccagttaggccaactaaaaatgtctttaggccaagtgcggtggctcacgcctgtaatcccagcactttgggaggcggatcacccaaggtcaggagtttgagaccagcctggcccacatggtgaaatatcatctctactaaaaaatacagaaaaaaaatagccgagcatggtggcatgcacctgtattccctgctactggggtgggtgaggcatgagaatcgcttgaacccgggaggcagagttgcagttagcgagatcatgccaccgnactccagcctgggtgacagagcaagactct

SEQ ID NO: 36274 - DNA, 294 bp, Homo sapiens
  misc_feature 8: n = A,T,C or G
ccaaaatnaaaataaaataccatttacaattgctaaacaattaaatatgtagttgtaaatcaaaccaaacatgttcagaatttgtatgctcaaaaccacaaaactctgaagaaagaaacttaagaatatctgaataaaaagacagacaatgttcatgaatatgaagacttcacgtagtgaatatgtcgattttccccaaattggtagacaggtttaatgcaattcctatagaaatcccagaaagatttttctgtggatatagacaatattattctaaacattacataggaagac

SEQ ID NO: 36275 - DNA, 104 bp, Homo sapiens
acagatgcattatccagaactgaagttgccctacttttaactttgaacttggctaattcaaagatagactcttcttttgtaaagtaaataaattcttcaaaatg

SEQ ID NO: 36276 - DNA, 347 bp, Homo sapiens
gagcacaaaaagaaatgcacgatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtaagttttttttttt

SEQ ID NO: 36277 - DNA, 469 bp, Homo sapiens
gacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagt

SEQ ID NO: 36278 - DNA, 469 bp, Homo sapiens
ctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagt

SEQ ID NO: 36279 - DNA, 472 bp, Homo sapiens
caagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctggagaagtccagggtctgaattgttgtctctgattacctggaaggacaggttaacctgaatgtctgtgatcactaacaggtgatgggcctttgtgcccactccagagatattgtggggagacaaattcttttaacagcctgtcctcccggcatcaggagtcattgaac

SEQ ID NO: 36280 - DNA, 323 bp, Homo sapiens
  misc_feature 13: n = A,T,C or G
gatgaataaaacnacgacaagaagatccttcagaaaacaactcgagacacagtcacattttaaaatgacagaatatttagtacttgaaattgtgggagcctggtgttcctggttggggtatggctgacattctagagggtgactgtggtgggtatcctaagtgtacacaaattaaaagaccccagaggataagtttgtgtctaatcccaaagaaaactcaaggcaatggaacatagttaccacattccaagggcaaagacctgggccaaattcaggcaaattcaaggctcagaatctccaaaagaactgaaatgaaaaagaac

SEQ ID NO: 36281 - DNA, 282 bp, Homo sapiens
  misc_feature 19: n = A,T,C or G
taacaattccttgaaaacncacactatcaaaattcattcaaagtgaaatagatcataggaaccattgtataactattaaagagattaaaactttaaccacaaccttctgaaaaagaaatctccaggcccagatagtttcactaacaaattctacgaaacctttaaataattccagttctacataagctcttccagaaaatagaagactaagggacacttctcaattcaactaaatttaggaggctgatgttaaccttaatgccaaaccaggcaaaaacagtg

SEQ ID NO: 36282 - DNA, 468 bp, Homo sapiens
  misc_feature 13, 462: n = A,T,C or G
gagtgaacggagnagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggacttgaggtacccaagagtggcaagggcaagaagaagtccaagccagtcaacaaagaccgctacatctccaagatgttcctgcgcggggactcagtnttcgtg

SEQ ID NO: 36283 - DNA, 264 bp, Homo sapiens
  misc_feature 16: n = A,T,C or G
agaacacattattttnaagactaaatctaaaacccagagtaaacatcaatgctcagagttagcataatttggagctattcaggaattgcagagaaatgcattttcacagaaatcaagatgttatttttgtatactatatcacttagacaactgtgcttcatttgctgtaatcagtttttaaaagtcagatggaaagagcaacctgaagtcctagaaaatagaaatgtaattttaaactattccaataaagctggaggaggaagg

SEQ ID NO: 36284 - DNA, 214 bp, Homo sapiens
tattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatg

SEQ ID NO: 36285 - DNA, 467 bp, Homo sapiens
  misc_feature 39: n = A,T,C or G
gactcccgactctactgactcccaacagagcgcccaagnaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagt

SEQ ID NO: 36286 - DNA, 140 bp, Homo sapiens
cactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttg

SEQ ID NO: 36287 - DNA, 471 bp, Homo sapiens
atgacaagagcattgtggacagtggcaccaccaaccttcgtttgcccaagaaagtgtttgaagctgcagtcaaatccatcaaggcagtctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggaca

SEQ ID NO: 36288 - DNA, 138 bp, Homo sapiens
catgaacacagtgccatatgaataatttcacatacagaacctttttttctctgaagtcctgtggacttgcaaatatatatatattgctttgttaatttgtttttatatttcatatatgtaataaaggaatatgatctg

SEQ ID NO: 36289 - DNA, 471 bp, Homo sapiens
  misc_feature 369: n = A,T,C or G
ggggctggcgggaaggctctggcttgggacgaaagtgtcgaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggngaatggccttccttcccgccagagggcttgtgaacagaccggagaggacagtggattgtttatactccagtgtacatagtgtaatgtagccgtgtttacatt

SEQ ID NO: 36290 - DNA, 467 bp, Homo sapiens
  misc_feature 6, 19: n = A,T,C or G
attacngtaagcataagtnatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatcttgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaatttaaatttcaaatatttaaaaatactattttatataattccttatgacattttaaactttatattttaaaatattt

SEQ ID NO: 36291 - DNA, 302 bp, Homo sapiens
  misc_feature 31, 301: n = A,T,C or G
ggaagaagaggaaagaacaagaggacgaagnagtaaaagaaaaggaaagaagaaagaagaagaggaagaagaaagaagaagaaagaataagaaggatgaagaagaggaagaaagaagaaaagaggaaagaaagaaggaagaagaaaggaaagaagaagaaaaggaaagaaggaagaagaggaagaaggaggaaagaaaaggaaagaaaaagaaaagaaaggaacgaagaaaaagaaaagaataaggaagaagaggaagaagaaaggaaagaaagaaaaagaagatagaaggaaagaagatng

SEQ ID NO: 36292 - DNA, 309 bp, Homo sapiens
aagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagggtttcacaaatccttcaaaataaaaagtaatgacttagaaactc

SEQ ID NO: 36293 - DNA, 383 bp, Homo sapiens
  misc_feature 22, 280: n = A,T,C or G
gaataaatagtggtgccatagnaagtaatgaaataaataagaaagatttgggaagacagggaaaaggaatcaccattccttgcagagtaagatatgataagctcagttttagatatctcaatttgttagtagtatctgtagtgctcccagatagaaatattcactgggagccagaaatgcaggattggaatttgagagaatgtagagcttcaaaatcaaatgagaattagtgtgttagttctattatatcagtaagtgggagcttgtaatgaaggcagancccagaaagtatgtcatagagctataagaggagaaggccaaggacagagcctaattaaacactagtattaagggacagtcaaaggaagagagaattaagaaag

SEQ ID NO: 36294 - DNA, 471 bp, Homo sapiens
  misc_feature 14: n = A,T,C or G
agaataacaacagnaaaataaagcctgtatgttccttctcccttttacttgttaagcaaatcttgaagaagttacttgactcattgttctgaatgtcttaatcagtcactttaattttttgaaagaatttccttgaaagtgttcttaaataaaaatagggatcttcctgttagtgagtgtaaaattactcagcagtgattctttggttttgtgaaacttaagggaagactaactcttctttctctatcccttccttccattccctctgcagtccatcatcttggttcaggcctttgtgacagttcttgcctagcctcccaaaagatagctttccccacttctcctgcttgtcagtgttttcaaccacctgcagatgacttcttcaggtcagcagtagttgtcacttacctcttggaccaaccttttgggattccttattgcctgatgaatttaatgggatttcttaccata

SEQ ID NO: 36295 - DNA, 472 bp, Homo sapiens
gggaaatgcagcaatttctggactagctgagccgattccttcctgtgagcacactgtaagctttcaagttctctgggcaggaattacagcacctgtcccctgcaatggccctgctgtgtgatgctcattgcttccctttgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctat

SEQ ID NO: 36296 - DNA, 309 bp, Homo sapiens
gattgtgctagatgtacctgcccaagtctgctggtcacatttggcagcaaaatggatttctcctgggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaacttctttaaaatttaaaac

SEQ ID NO: 36297 - DNA, 471 bp, Homo sapiens
atgattctgtgattaacaagcatatttctggtgctatcatatggaaaagttagcatttattctcccttaacattttattggcatcttcgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaaggttccattaaggacttttggcatctgtaccttaaagatatttcaaaaataattgtgctttattgcttcttctctgccatagcatataacaagcgttttttaaaagaccaaatacagctctctgatttccatttaatggaagaagaataaagtttaattgtatacgtgagcatg

SEQ ID NO: 36298 - DNA, 122 bp, Homo sapiens
agttgaagttagaggaaaattcatagccttaaatacctacattacaaaatgataacatcgaagttttgaaaagctaaggatatatctcagaatttgagaaaataaaatggaaataacccccc

SEQ ID NO: 36299 - DNA, 471 bp, Homo sapiens
  misc_feature 32: n = A,T,C or G
aatcggcaaaatgtggagtgtatgttcttttncagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgcctta

SEQ ID NO: 36300 - DNA, 223 bp, Homo sapiens
agaactgtaaatgagcagttctttagagatgtaataaggaatctcatgtctactttaggaatgagattttaggtcttttggtagaaaggttgggtgataaaacatctctccctctctttttttttggaggtgtagtttcgttcttgttgcccaggctggagttcagtgagccgagatcgcgccacttgcacttcagcctgagcaacagagcgatattccatct

SEQ ID NO: 36301 - DNA, 471 bp, Homo sapiens
gtccagccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgtccaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctct

SEQ ID NO: 36302 - DNA, 227 bp, Homo sapiens
cattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcacc

SEQ ID NO: 36303 - DNA, 467 bp, Homo sapiens
  misc_feature 108, 141, 393: n = A,T,C or G
gggcgcggtggcgcgtgcctgtagtcccaagtacctgggactacaggcgtgagctaccatgcccggctaatttttgtatttttagtagagatggggtttcattatgtnggccaggctggtctcgaactccttacctcaggngatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggngttcctggctctcctgcccacaggatgaacattttcggcttccttaggagttttgtcctaccgtattccaaagc

SEQ ID NO: 36304 - DNA, 471 bp, Homo sapiens
  misc_feature 468: n = A,T,C or G
gaaagtaaagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaaccgtaattgcggtttttgcattgttgaaatttgccgttttatattggagtacattcttaaataaatgtggttatgttatacatcattttaagcatatttctcactttttttttgctaatgacttattgctgntta

SEQ ID NO: 36305 - DNA, 120 bp, Homo sapiens
  misc_feature 26, 54, 64, 75, 116: n = A,T,C or G
acctactacagaggagcaagaagccngctgcataaactcttaaatttgattatnccataaaggncaaatcatttnggacagcttcttttgaataaagacctgattatacaggcagngagg

SEQ ID NO: 36306 - DNA, 285 bp, Homo sapiens
  misc_feature 3, 13, 27, 28, 31, 33, 51, 81, 83: n = A,T,C or G
aangcattaagcnaaacttatgtaagnnatnanaaagtattttctgttgtntttggctcatgaaagactacagtggctggncntggtggctcaggcctgtaatcccagcactttgggaggctgagatgagcaggtcatttgagcccaggagtttgagaccagcctggccaacatggtgaaaccccgtctctactacaaatacaaaatttagccggacatggtggcacatgcctgtaatcccagctacttgggaggcaaaggcaggagcatctcttgaaccctgga

SEQ ID NO: 36307 - DNA, 159 bp, Homo sapiens
  misc_feature 159: n = A,T,C or G
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgan

SEQ ID NO: 36308 - DNA, 369 bp, Homo sapiens
  misc_feature 6, 33, 364: n = A,T,C or G
gaatanctctgtactcgtgcctcatggatcctnattaaagaacttccagaactcgggacaactcagctattaaaggattaacagctggcaaatactctgtggccatcatctcatctgattggtagaaacaaaaaatatacatgttgttaaaatatgttgggtttatgtgtacatatatcaaaacattgttttacaccttgaatatatacaatttttgttaattataactcaataaagctgaaattttaaaagtgaaataaaaaagaagtggaagtagtatttttctataaattagaaatcacttgtttgataattcactttgacctgtagcctatcaaatagttatcttgatcaatatgttttntttca

SEQ ID NO: 36309 - DNA, 333 bp, Homo sapiens
  misc_feature 5, 6: n = A,T,C or G
agttnnaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgc

SEQ ID NO: 36310 - DNA, 237 bp, Homo sapiens
aggccaaggtgggcggataacctgaggtcaggatttcgagaccagcctggccaacatggcgaaacaacgtcattactaaaaatacaaaaattagctgggcatggtggcaggtgcctgtaatcccagctactcgggaggctgaggcaggagaatctcttgaacccaggaggcagaggttgcagtgagccaagatcacgccattgcactgcagcctgggtgacaaaagcaaaactccat

SEQ ID NO: 36311 - DNA, 436 bp, Homo sapiens
ggcagcgtgtggatttgaggacctctgcttaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaag

SEQ ID NO: 36312 - DNA, 225 bp, Homo sapiens
gagttggagaccagcctggaccacatagtgagactctgtctctacaaaagcacaataaaaattagccaggcatggtggcacacacctgtagtcccagctactcaggaggccaaaccagaggagttgttgagcccaggaggtcaaggctgcagtgagttgtgatggcgtcgctgcgcttcagcctggggcaactccagcctgtgagactttgtctctaaaaaaatg

SEQ ID NO: 36313 - DNA, 121 bp, Homo sapiens
  misc_feature 83: n = A,T,C or G
caaaattgaaaagtacaagaatatggatatcttcttataatatatgtgtgtatgcgtgtgtgtgtgtgtgtgtgtgtgtgtgngcatgcatataaagtaaataaagctgggcacggcctgt

SEQ ID NO: 36314 - DNA, 265 bp, Homo sapiens
  misc_feature 6, 7, 32: n = A,T,C or G
aggagnngcaagctgagaggaccccaggctgntgtcctcccccgctctccatccaccaaactctcagttcctagagtgggagcgtcactcagagaagtttgctgttgtccccaaccccagctccagagccctaactctgagatttttacctgtggagaaaaacaaaccataaaacagctcctaatttcttcccaaaggaactgacttcatttgcaacagggagtgaagaagttcaaacctgattgtactctcaagaacagtagag

SEQ ID NO: 36315 - DNA, 221 bp, Homo sapiens
  misc_feature 8, 21, 27, 37, 42, 48, 53, 56, 68, 71, 105, 136, 150, 215: n = A,T,C or G
aaggagcnatttatagcatanatgtanaaaactattntgggntagaanacatntgnatcacacctgtnctnatgaggtgcatgggaagggcatggaggtctctgnaacagtcttggatctctatgagggaagtcancactttgggtattngtcattgaccataagccctccttcaggctgatagcaaggatacaaatacctgtgcaggtttcatncaactc

SEQ ID NO: 36316 - DNA, 260 bp, Homo sapiens
  misc_feature 30, 259: n = A,T,C or G
cagaaacaaatactgattgctttctatgtnactttattcttttgaaatttgagattttataagaaattttgaaaatgtatattattctcttgtcttgaaaatgtttttaagtgggaatataagaaacaaggatgtgttgctgcttaattctgtgcctgaactttggagtcttctgatctgtgtttgggacagagaatgctctagctatgctaaaaccttttcaataattgtaacgttgtttgatgttagcaaaaaaacnc

SEQ ID NO: 36317 - DNA, 304 bp, Homo sapiens
  misc_feature 14, 302, 303: n = A,T,C or G
cgtctcgcgaaatntatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattnnc

SEQ ID NO: 36318 - DNA, 150 bp, Homo sapiens
agaatatctgttgtaacattgcttcatgtgggtctggatggaagattagtgggcctacaggatcatttatttatattgtttatattacaataatatattgtagatcagttgtaagttcatttctttacaaataaaagcctcttccatttg

SEQ ID NO: 36319 - DNA, 383 bp, Homo sapiens
gtaaaccccggagcgaggttctgcttacccgaggccgctgctgtgcgggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaagcgggggggcattcaacagtttaga

SEQ ID NO: 36320 - DNA, 367 bp, Homo sapiens
  misc_feature 6, 21, 31: n = A,T,C or G
ggctcnaagctgcagcaaganaaactgtgtntgaggggaagaggcctgtttcgctgtcgggtctctagttcttgcacgctctttaagagtctgcactggaggaactcctgccattaccagctcccttcttgcagaagggagggggaaacatacatttatccatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttca

SEQ ID NO: 36321 - DNA, 356 bp, Homo sapiens
  misc_feature 6, 7, 31, 356: n = A,T,C or G
gtttcnngaaccagcagaatcagtgcctagnctgtgcccagcaaatagttggcactcaataaagatttgcagaatttaatacagatcttttcagctgctcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggctttttttttttttan

SEQ ID NO: 36322 - DNA, 188 bp, Homo sapiens
  misc_feature 5, 30: n = A,T,C or G
tctgnaggatggttgcacgaaacacactgntgaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcct

SEQ ID NO: 36323 - DNA, 179 bp, Homo sapiens
cagttggtgagtgtccggccccagtaccagtgaaggacaagaaacttctggaggtcaaactgggggagctgccaagctggatcttgatgcgggacttcagtcctagtggcattttcggagcgtttcaaagaggtcagagccttgtggatgtctgtaaatgaaagcaaatctctgggtct

SEQ ID NO: 36324 - DNA, 218 bp, Homo sapiens
  misc_feature 28, 195: n = A,T,C or G
gtcggcaaaattcaggaattaaaacttnacatcttatgagcatttccctagatcttcagaagatgttgtgctccctctttaggatgaatggatatgtagattcaattttcaatgagtttttgtctaatttcacagccaagaagagattgaaatggtgggccacaggagatcagcacacctttcagaagtgacagntgttggcttgcaagtaaagagac

SEQ ID NO: 36325 - DNA, 381 bp, Homo sapiens
cgatggacacgactgcgagccgtcggaccctgagcaggagacgcgaaccaacatgctgctggagctcgcaaggtcacttttcaataggatggactttgaagacttggggttggcagtagattgggaccaccacctgcctccaccagctgccaagactgtggttgagaacctccccaggacagtcatcagaggctctcaggctgacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttatta

SEQ ID NO: 36326 - DNA, 387 bp, Homo sapiens
  misc_feature 7, 31: n = A,T,C or G
gaaaacncttggttgcttatcttgtaaaatntgctctgcttgcttgcttgggcatgtatgtagtcagtttagtcaaatacgtgtcagtacatctatgtggatggggagcaggtgcaagcccttaaaaacgtactttaaaaaactttaacacttaagtcagtccactgagctgatcctgtgtgatcttagtgccaagcgtctgagtttaaagttttccctttgaaggcagcaaatagatgtcatacatttgaagcatttgtttatactaaatatgatgcttgatttttttttaagttctaagacagttcactgttcaacaccattgagcctgcagggtggtataaagcttccaaagctggtatttgaggtttgatttaatggatattg

SEQ ID NO: 36327 - DNA, 432 bp, Homo sapiens
  misc_feature 32: n = A,T,C or G
agtctaccttcttttttaggcagtgcttttanattgaagacaaaaagaaacaaaaaacaacaatatttttgagtccccagtcaggtatgtgggttttaaaaaaaacaaatgtgtgttattttatttactgcatactttaccacatgccttttgagactttttctccaaatatgtgcttttaacagggattggacatcagaatcacttgggggaactttaaaacatatagttgcccatcctctacctttatttcctaaaggtaattcttcagtggttaagcatgggcctgtgtgttttgtaaattccaagtgatgtttataccacccatgagtggcaaccagagtcttcaattatttgttccagtcccgtgctttttgttgctgctgtcttgccagcagtgttttctcctcctggagagtatttgccacacgc

SEQ ID NO: 36328 - DNA, 327 bp, Homo sapiens
  misc_feature 8: n = A,T,C or G
caagaagnatgtccaaaatgatttgttttaccatgggaaaattcttactattcaacaaactctcagttggccccctacagcagtctggtgttgaagtttctttgaacgaactaaatatactcattttatgtaaaggtatccaatttgattttgaaaccaaagtagaaaatgcaaaattctaaattccatgaaacatggaatttatgacaccaaaatcaatggagagtaagcagcagcaaactgagaattatccagcatatgaatataacaatgtgtttttaagtaatcaattcatttaaaaaattgaatattaatacaaagcatatt

SEQ ID NO: 36329 - DNA, 481 bp, Homo sapiens
  misc_feature 42, 44, 45, 464: n = A,T,C or G
tatggccgggaactccccaaactataagtaattctcaagaantnnctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggnaaagcctcatttgaatg

SEQ ID NO: 36330 - DNA, 460 bp, Homo sapiens
gtaaggcattttgtgtttttaagttggtttttcaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggaac

SEQ ID NO: 36331 - DNA, 486 bp, Homo sapiens
  misc_feature 6, 32, 34, 356, 416: n = A,T,C or G
gctgcnccgcttgaggagaagcgccaagtgcncntggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgaggtatgtttatttaatctcatataactaaactagtataagcaaagttcgtcaattctgtagttttccacatttcccccttggggatttgcttttactctttagttaaagagaaatgatattctttatcatcttgatattttcttactaataaagngacaactttaacaacaataacaacaaaaaattgattaaaggataacatctgaacatcagnggacaacctggtcagcaggatcagttgcaaaatcaatagcaaagtgcttacttaagcagcacctatacta

SEQ ID NO: 36332 - DNA, 101 bp, Homo sapiens
accaaggctgggcccagaacacatagtcctagggtaacagtgaaggggtcgtgaggggacagtgactcccttccaaccccttcttcatagggactgttgac

SEQ ID NO: 36333 - DNA, 183 bp, Homo sapiens
tcattgagacttttctcagatactttttggtttacaacgccaatactaaataatctaaaaaagaaattaaaaattaatgccatttatgataactacaaataaatacctaggaattaaccaaagaagtaaaagatcttgctaatgaaaactataaaacactgatgcaagaaattgaagaggaca

SEQ ID NO: 36334 - DNA, 403 bp, Homo sapiens
gaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatacgtagaacatgagtctctcctccctaaaattttaaatgtagaaaagtgctatatattagaaatttccattttgttaaataaatggttagagtctat

SEQ ID NO: 36335 - DNA, 487 bp, Homo sapiens
  misc_feature 2, 31, 32, 35, 59, 211, 387, 427: n = A,T,C or G
anaagcccatgattgaatctgttttaggtgnntgnacaatggacattaagaatttcccncaataatttatgaataagtttccagaacaaatttcctaataacacaatcagattggttttattcttttattttacgaataaaaaatgtatttttcagtatccttgagatttagaacatctgtgtcacttcagataacattttagtttcaagnttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaaggagtgngtgtatcagaagtaattttttaatgtcttctaaggatggncttccaggcttttaaactgaaagcttaattcagatagtagcttttggctgagaaaaggat

SEQ ID NO: 36336 - DNA, 487 bp, Homo sapiens
  misc_feature 6, 357: n = A,T,C or G
ggcccncgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggnggaaggctctatagctgagaagtggaaggatcgactcggtaaaaaagttaagcgctgggatatgaagcttcgtcatcttggactcagtaaaagtgattctagcaatagtgattccactcagagtcagaag

SEQ ID NO: 36337 - DNA, 444 bp, Homo sapiens
  misc_feature 6, 7, 59, 146, 321, 435: n = A,T,C or G
ggggannaaaggcagctttctgttttataaatgcagacttctgtttattgaatgaagcntatctcagtgtttatctgtcaggttttgaaacatttcatatatgtccaaatacttggcaggatttaaaaaaaaatagtgaatttggngtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgngtctgtttatattgcttccttttttgtagcctttgtacctgtacagggtgacagtaagggccaagcaggagaggcgtaatccttgtataaaataggatccagcgacactcttgnatttatctg

SEQ ID NO: 36338 - DNA, 487 bp, Homo sapiens
  misc_feature 31, 32, 35, 337, 423, 486: n = A,T,C or G
actatgccttccagcactgtcccggtgagcnntgntggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagcttgaagtttgattcanatgggcactttttcttccccttccctgcctagtttccttttgttccttgagtccacgcagaattccattctctggtcagcagacanggcttaagctaaagtattgcctctattctgtaaagttctgtacatagttcccaagcttctgang

SEQ ID NO: 36339 - DNA, 378 bp, Homo sapiens
  misc_feature 216, 282: n = A,T,C or G
ggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggngttctatttatttattgtcttcctgtaagaccttcgggtcaaggcagaggcaggaaactaactggngtgagtcaaatgccccctgagtgactgcccccagcccaggccagaagacctcccttcaggtgccgggcgcaggaactgtgtgtgtcctacacaatg

SEQ ID NO: 36340 - DNA, 425 bp, Homo sapiens
  misc_feature 32, 406: n = A,T,C or G
aaccaccgtctgaattctcgcagaaggcgttntttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtaggtgatattatgtcgngactttaggagaagtaatg

SEQ ID NO: 36341 - DNA, 370 bp, Homo sapiens
tcagtcccatttgcggaggaacattggtgtttttgcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtct

SEQ ID NO: 36342 - DNA, 219 bp, Homo sapiens
aattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttac

SEQ ID NO: 36343 - DNA, 440 bp, Homo sapiens
  misc_feature 33, 426: n = A,T,C or G
gggttcccgccctgacagattctcctatcggtntcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattaagcgcagagaccttcactgccctatcagtactaggtgtaatggtctatggaattaaaaaatatggnccctttgttgcaga

SEQ ID NO: 36344 - DNA, 458 bp, Homo sapiens
cacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccat

SEQ ID NO: 36345 - DNA, 480 bp, Homo sapiens
  misc_feature 385, 390: n = A,T,C or G
gcaaactaatctggcttgaaactcaattaggctggagtaaatgctcaagagtgtgaaagtgaggtcatctgttgcaatacttgggcagtaagtagcaggggcctgacatgttaaggtgactataagactagaaacaagatctctgcaaggaaaagaatcaatgaggctggacaaataactggagacaagagaggagatgggtgataaagggagtgctttctaatgtgtattggtagatgtttccagtgacactacttagtatcacagatgttactgagactttgctcaagtcaacttgtaattgcatgcactgattttctctgtaagacttctcagagcctataatatgctaacatgcgctgtgacactccaagaagaagatggngttgnctaatttcccatacttatttgtccacagaaactcttttttaaaaataagctaggcacagtggctcatgcctgtaatcctagcagtttgga

SEQ ID NO: 36346 - DNA, 426 bp, Homo sapiens
  misc_feature 25: n = A,T,C or G
atgcctaagagctgcccagcacaanagtcaataaaaaccctagaatagagtttataggggttgtctatgtacataattaaatccttcaggcactttaaaactctgcaaaataaatggttatgcaagaatagcctgctgagagaagaaatgcttgtatcagctttaaccagctgccctgtgttccatgtttctgggttggaatgagaaagctattagaacactggaagactgcaagccacatacaaatcatctttgttactgacacttgggggagtactttatagtggctgtcaagaccaatacaaaacatggtttgtgcctgaaaaagtcaagtgccattattcaaaaagaagatgttagtaatccaaataactgaacaacatccaggatcttcattgagtttagctgctatagacgcagatttat

SEQ ID NO: 36347 - DNA, 416 bp, Homo sapiens
  misc_feature 25, 385: n = A,T,C or G
tgtgtccctgtgggtggacgtggcnggtgattggcaggatcctggtatccgctaacaggtcaaaatgcagatcttcgtgaaaacccttaccggcaagaccatcacccttgaggtggagtccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccangataaagaaggcatccctcccgaccagcaga

SEQ ID NO: 36348 - DNA, 382 bp, Homo sapiens
  misc_feature 33, 152: n = A,T,C or G
agggaacgccaagtatgatgtcagaagctgacnttagtttctgccatagttacagggaggcaagaagcagcaaggtagcccggactttctactcttccacctgctgaggccagtcagcaacaatagaggagtctgtatggggcagggactangagagaagggcagtgctctcaggagctggagacacctgcgagaaagaaaaacccaggttaagaagactggtattttgaaaatagtgccaagagttaggccaatagtagttcccatccctgctctccaagtggctctctcaaatagatgcagatgacattctagcaggaaacttcagttacaaaaatcagtacaaaaacaagaatgagcaaacatttgaggaaggccaaca

SEQ ID NO: 36349 - DNA, 109 bp, Homo sapiens
cagtcggctggagtcggaggcgatatttctaggggtgtacttgttggggtcagggtaagcaccagccacaaaaacctacaaaagaagggaaattactgtctttaaatat

SEQ ID NO: 36350 - DNA, 472 bp, Homo sapiens
  misc_feature 33, 125, 196, 212, 233, 320, 470: n = A,T,C or G
atccgcctgtggaagctctcactgtgaacctgntaacatacatttcagtgtctacaaaatgtcttttgagagaaaacagcagggacattcgtgagctcttttttttttctaaccactttcccagngagacttcagttttcattctccccttagcagctttcaaatatgtacgtaacacaaatgttacatgtctgancatttaaactgaattnggacagggcttctatttccanaaccttctaactctatttctttgtggcctgatagtcttgctctccagggtaaaagaagaggatggaaatggctgtggggcgcctganctgggccctggcatgatggcaagatgccgttctgggttcactgggatggctcaaggggagtttggaaaccctcctaacatgtcatctgaaatctgggaccacagttccggctggaacacttgtcactaaagctgctgataagcaaagggngt

SEQ ID NO: 36351 - DNA, 489 bp, Homo sapiens
  misc_feature 5, 8, 32, 395, 418, 419: n = A,T,C or G
caganacnagttcctatgtatgtcctttgttncttcaatagctaattaatgtgcttgaggatacttcgtggaaaaaaaggtttaaatatgcaaattactaataaatgtgtaaccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtttcattttgaaacgatgtacagacaagtccccaacttagaaaccggtttgttcttaaggttcttgcgtcagcccatggaagcccactgacctccaccacagcccaaatggagggctgtggnggccagatctggttggcttttgnngggctgacccaaacatttaatcaccatctcttatgttgttgccgtaagaaatgcattccagggtggggac

SEQ ID NO: 36352 - DNA, 334 bp, Homo sapiens
  misc_feature 10, 281, 333: n = A,T,C or G
ctgaaacgtnagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaanaatgtgccctacgtgtttgtgcgctccaagcaggcccctggggagagcctgng

SEQ ID NO: 36353 - DNA, 500 bp, Homo sapiens
tatggtttaacatacacagttcaataaatgtgatacaccacacaaacaattaaaaacaaaaatcatgtgatcatctcaatagatgcagaaaaagcattcaacaaaatccagcattgctttatgattaaaactctcagcaaaatgggcagacaagggacaggtatgtcccttgtaataaaagccctctatgatagacccacagccaacataatactgagtggggaaaagttgaaagcattccctctgagaactggaacaagacaaggatgcccactctcaccactcctcttcaacatagtactggaagtccaagccagagcaatcagacaagagaaagaaataaagggcatccaaattggtaaagggaaagtcaaactgtcactgtttgctggtgatatgattgtttaccttgaaaactccaaagactcctccagaaagctcttagaacagataaaagaattcagcaaagtttctggatacaagattaatgtacacaaatc

SEQ ID NO: 36354 - DNA, 282 bp, Homo sapiens
tctcggggtcgctgtcggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaaccccagtgaagaagttacctggaagtaaagactggctagattatcgaatgttcacattttaaagttctgagagaaataaaaacatgaagaatttc

SEQ ID NO: 36355 - DNA, 352 bp, Homo sapiens
gactgccaaactaaagtgcaaagaatcagattctcctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttg

SEQ ID NO: 36356 - DNA, 158 bp, Homo sapiens
  misc_feature 34: n = A,T,C or G
gactctcagcggtggatcactcggctcgtgcttngatgaagaacgcagctagctgcgagaattaatgtgaattgcaggacacattgatcatcgacacttcgaacgcacttgcggccccgggttcctcccggggctacgcctgtctgagcgtcgcttac

SEQ ID NO: 36357 - DNA, 483 bp, Homo sapiens
  misc_feature 7: n = A,T,C or G
aaagccnccgtagcacccagcaccctgaggtttttgctgctttttggctgtagggattctgctcccagtagcaagatgtgtttgatgagatacatccgtccttttttaccataaagtttgtacagtctcctacctatctgggttggtttgaaacaatgtgatcaattccctgtgagttagaagtatagcaccacttagaatagacagtttgttaccacattgttaaaatctaatgataggctgggtggttcaggcctgtaaccccagcactttgggaggccaaggcaggaggattgcttgagttgaggagttcaggctcagcctgggcaacatagcaagattccatctccataaaaaatgtttaaagattagtctgccatggtggcacacgcctatagtcccagctactcaggaggcggagctaaagaggcttgcttgagcctggggaggtcaaggctccggtgagctgtgattgcgccactg

SEQ ID NO: 36358 - DNA, 488 bp, Homo sapiens
  misc_feature 43, 452, 483: n = A,T,C or G
atggccgggcacacacatgcatgcacatacaggcacactcttncatgcaccaccatgcacacacacatgcatgcacacacaggcacattcatgcacacacagcttgcacagtgtctgagtcataacaaaataggctatgtcttgaaatctcagtggcttaatacagcaacaattgcttcctcacttgcatagacagaagactctgggagcttccatcttgtggctccatacactcaacacataattccttgatctccaaggcaagaaaattatgcccactgtctttgaacttccatttgccagcaagggcaggtttacacacctccccccaaccccataacatgacaaaatggtaaaatgacatgcacacacctcagacgatgaaacaccctttgccatcattttgttctctttgagccagttttcaatgagctgaaatgcaattaaatggntggttgcgggctcattctgggtctcctggangatgc

SEQ ID NO: 36359 - DNA, 483 bp, Homo sapiens
  misc_feature 25: n = A,T,C or G
cggctctctgaccgcaccatggcgnttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttgggttttactaaaaaacgcaacaatcagatacggaagacctctta

SEQ ID NO: 36360 - DNA, 336 bp, Homo sapiens
  misc_feature 25: n = A,T,C or G
aaagacaaattttcttcaggcacangcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggggatggcatgttatactgtaggtactatttgttgtaggatttctcacagttcgtttgccttgactaaatggtaactgcacacatactatactataaatg

SEQ ID NO: 36361 - DNA, 383 bp, Homo sapiens
  misc_feature 25: n = A,T,C or G
gagagtattagaaagtaaagaatgnaattctataatcagctacatatggataggcagagagaggggtctgcttcttgtccagctgtagctctgtgctagtggaagcatgtcctggagttcacgatgtggccaagagaacagatgtagttaggcaatggaggtgggacagagagctgcaaagtgctgcacttgcccctcttactggacccaaaaggctctcaagtgtaacacctttctgtagtgctgtagatcattaatctgggtgtgtgatgaccatctgatctagcacatccagtggcattgtgcatattgggataggaatttgattttgtgaactcaagctattcagcagggcccatgaaaaatcaccagaagggtaggtg

SEQ ID NO: 36362 - DNA, 230 bp, Homo sapiens
gatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactag

SEQ ID NO: 36363 - DNA, 469 bp, Homo sapiens
  misc_feature 42: n = A,T,C or G
tatggccggggatttacgactatgatttacctatacattatnttttattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctg

SEQ ID NO: 36364 - DNA, 151 bp, Homo sapiens
tagcattgttgtgaggtttggctggcacaagataaagtgctgtgtaattactctgaaatgtttgtaattaataaagaaatgaattgtaggcactttgtcagtagaaaccactgtgatttggaaacgcaatgtttcaataataaagactttt

SEQ ID NO: 36365 - DNA, 458 bp, Homo sapiens
  misc_feature 6, 31, 32, 437, 457: n = A,T,C or G
gtgggncgtttctgcatttggactgaaagtnntttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccgggaatcacaagctccgggtggataaggcagcttgctgcagcagcggcacctacaagccaaatcagatgagaaggcggcggttgcaggcaaggagcctgtggtaggtaagaaaggaaagaaggctgctgttggtgttaanaagcagaagaagcctctggng

SEQ ID NO: 36366 - DNA, 447 bp, Homo sapiens
  misc_feature 7, 30, 31, 347: n = A,T,C or G
ggtttcnagctttagttaggtgggtgttgnntgtgactgagtgtatgaatttttaaaaagtgattttgggatggattacacttgctaccttttgtcaactgatttttaaaaactttttgaattgtaggagattagaattaaagggatcattttgaagtgataactaggaaaataactgtggtaccatggagaaaactaaattaataactgcccactctggctaccaatcaggctattagcctgtaaagcaaaagtttgatgggaaattattttttaactctcccttggttagctgacttttctttagaattgtatttctaaatttcctttctactttttaaattggnagaagggacaaatgagaatacctgagtaaaggccctatttacagagcacaaattgagttaatttgattagcttactagtactctttaaaatactttttat

SEQ ID NO: 36367 - DNA, 309 bp, Homo sapiens
  misc_feature 57, 107, 181, 184: n = A,T,C or G
cttttctgcgtcttttgagatgagtatcaggttttttttttccttttatcatctgangatgaacttaatgtttccatttgtattaatggaatactaagtccctctgngatttctgaaccaagctattcctaggcctgagttttattttgttgacacagaaataaattagaaggccaagcgnggnggcatgtgcctgtagtcctagttgctgaggtaagaggattgcttgagcccaggagttcaaggctgcagcaagctttgattgcgccactgcactccagccttggcgacagactaagacgctgtccc

SEQ ID NO: 36368 - DNA, 271 bp, Homo sapiens
  misc_feature 24, 176, 177: n = A,T,C or G
gtgggtgacatggtgatggccacngtcaagaaaggcaaaccagagctcagaaaaaaggtacatccagcagtggtcattcgacaacgaaagtcataccgtagaaaagatagcgtgtttctttattttgaagataatgcaggagtcatagtgaacaataaaggcgagatgaaaggttnngccattacaggaccagtagcaaaggagtgtgcagacttgtggccccggattgcatccaatgctggcagcattgcatgattctccagtatatttg

SEQ ID NO: 36369 - DNA, 146 bp, Homo sapiens
  misc_feature 4: n = A,T,C or G
aagnagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 36370 - DNA, 205 bp, Homo sapiens
cagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaataggaagcttaaaataaagttaaactgatt

SEQ ID NO: 36371 - DNA, 397 bp, Homo sapiens
  misc_feature 23, 24: n = A,T,C or G
cacgatgttgtcaaggatggttnngggactagaggctcagtggtgggagagatccctgcagaacccaccaaccagaacgtggtttgcctgaggctgtaactgagagaaggattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgggaaatag

SEQ ID NO: 36372 - DNA, 280 bp, Homo sapiens
  misc_feature 22: n = A,T,C or G
gtggagcaggaaggagctctcnttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgt

SEQ ID NO: 36373 - DNA, 353 bp, Homo sapiens
  misc_feature 26, 350: n = A,T,C or G
actatgaacagggtgaaaaagtgtcngctccctatcatattagagaagtttgggtaaaatcattataggttctgaattgatgatgatgagctctctgccctccttccaagataaaaatgtttactatggtctctacctgattcctgagacatatgcaagtttgtgttctatacatgtttatatctacatgcctataccgattgtttacatatgtatataaaagggttaagttaatcttttggcatgaaattcatctaccagaaaaataatatgtgattatttgcagtagatctaaaatgcagacattaatatgaaactttttaacagtagcactgttctcactgagctgngtg

SEQ ID NO: 36374 - DNA, 169 bp, Homo sapiens
  misc_feature 163: n = A,T,C or G
ctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcntgctct

SEQ ID NO: 36375 - DNA, 188 bp, Homo sapiens
  misc_feature 187: n = A,T,C or G
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtanc

SEQ ID NO: 36376 - DNA, 394 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgatt

SEQ ID NO: 36377 - DNA, 330 bp, Homo sapiens
attgtccccatatcttgtgtgatctgtaatgacatcatggcctatatgtttggctttttctttggtcggaccccactcatcaagctgtccccgaagaaggcctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctgggtatgtgccactcacagggggtga

SEQ ID NO: 36378 - DNA, 138 bp, Homo sapiens
tggggatcaactttccttctgtgtgtggctcaggagttcttctgcagagatggcgctatctttcctcctcctgtgatgtcctgctcccaaccatttgtactcttcattacaaaagaaataaaaatattaacgttcacc

SEQ ID NO: 36379 - DNA, 324 bp, Homo sapiens
  misc_feature 10, 24, 31, 33: n = A,T,C or G
catgccaagnatgattaatacagnatcttantngaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttg

SEQ ID NO: 36380 - DNA, 355 bp, Homo sapiens
cacgtccgattttgcttggatcttggcaagtatccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctgacctgctgtgctcgcagtagattccaagttggatca

SEQ ID NO: 36381 - DNA, 234 bp, Homo sapiens
accccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttg

SEQ ID NO: 36382 - DNA, 282 bp, Homo sapiens
acaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggcccctgcgggagggaccctgctactcttgggctggcttgccttggctctttgaactcccttttgcttaattactgggttttctgggcagtttttttttttaaagagttggagtaaga

SEQ ID NO: 36383 - DNA, 119 bp, Homo sapiens
  misc_feature 108: n = A,T,C or G
actaggacttcttaatataactgttacactgtccttgtctttcctactcaaagacagtatcatctgaagttgcctaataaggtcatgtgagtcaagaactttatctgngggagctgatt

SEQ ID NO: 36384 - DNA, 388 bp, Homo sapiens
  misc_feature 11, 30: n = A,T,C or G
gttttcttgtntttttgttctttacatcangtaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagaga

SEQ ID NO: 36385 - DNA, 181 bp, Homo sapiens
  misc_feature 6: n = A,T,C or G
tacctngactcagcggtagcaacctcgcccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaag

SEQ ID NO: 36386 - DNA, 365 bp, Homo sapiens
  misc_feature 29, 31, 141, 149, 169, 181, 194, 208, 248, 250, 272, 303,311, 344: n = A,T,C or G
gaagcctgaggctttctcgaaagtgcttntntcgccagctacaaccgtggtcagaactttgaatgacagaagtagtattgtaatgggagaacctatttcacagtcatcatctaattctcagtgatttttttttttaaaganaattctanaattctattttgtctagggngatgtgctgtanagcaacattttancagtatcttccatngggtagatttctatataatataaatacattttaattattngnactaaaatgctcatttacatgngccatttttttaattcgagtaacccatattngtttaatngtatttacattataaatcaagaaatatttattnttaaaagtaagtcatttatac

SEQ ID NO: 36387 - DNA, 472 bp, Homo sapiens
  misc_feature 3, 5, 25, 52, 471: n = A,T,C or G
ggncntttatggccgagggtggtcngccactgcgcagaaccagacttcgctngtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaana

SEQ ID NO: 36388 - DNA, 368 bp, Homo sapiens
ggatggtggtgacatggacttgtttatagaggacaggtcaactgtctggctcggtgatctacattctgaagttgtctgaaaatgtcttcatgattaaattcagcctaaacgttttgccgggaacactgcagagacaatgctgtgagtttccagcctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccct

SEQ ID NO: 36389 - DNA, 276 bp, Homo sapiens
  misc_feature 5, 12, 76, 86, 131, 226: n = A,T,C or G
tgccncagcagnaattcttgtaacagagttttcaagattcttatagataaagtgaaagatgattctgacattgtcnagaaagaatntgcttctatacttggtcaacttgcctgtactcttcacggcatgtnttatctgacaagttctttaacagaacctttctctgaacacggacatgtggacctcttctgtaggaacttgaaagccacttctcaacatgaatgtncatcttctcaactaaaagcttctgtctgcaagccattccttttcctactg

SEQ ID NO: 36390 - DNA, 352 bp, Homo sapiens
  misc_feature 137, 196, 277, 350, 351: n = A,T,C or G
caatgtacatgatgacaaatgagtcttaattacatgaatacagatagtaagcttatactgtgcgtggtttgtgacatgcctgaaaacatgagtgtattgagtagatgaagactaaatcattaacagtcaaccattgngctccttgaattcttttttccttaaaaaacaattttttaaggggattaacacatctggntttgtgttgaaatatctcttaacgaaaatttatggtcttgaaataaagaccagggtgagaaaaaggagtcatctatttttncttattggctaatttattaatagccccatggaagggcatatgaccatcttacctaaattgatgttttcttagnng

SEQ ID NO: 36391 - DNA, 234 bp, Homo sapiens
  misc_feature 125, 152, 153: n = A,T,C or G
gaaattatgaaatgtaatgaaattgaaatgaaattgaaatgagatgagttgaaatgatgagatgtaatgatgaaatgaaatgatgaaatgagatgagatgaaatgagatgaaataatgagatganttgagatgatgagatgagatcatgagnngaaatgatgaaattaaatgaaatgatggatgaaatgatgagatgaaatgagatgaaatgtaatgagatgaaatgaaatgac

SEQ ID NO: 36392 - DNA, 361 bp, Homo sapiens
  misc_feature 24: n = A,T,C or G
aaccaatgattttagtggtgctanggcagctgcagttttgagttagattaatgtggtgaaaaccatcaaatacttagaaattgactgggtgcggtggctcatgcctgtaatcccagcactttgggaggccgaggtaggtggatcactttgaggtcaggagttcgagaccagcctggccaacatggcaaaaccccgtctctactaaagatacaaaaattggctgggcacgatggagggtgcctgtggtcccagctactcggggggctgaggtgggagaattgcttggacccaggtggcagaggttgcagtgagccaagattgtgccactgccctccagcctgggcaacaaagcgaagctctg

SEQ ID NO: 36393 - DNA, 440 bp, Homo sapiens
  misc_feature 2, 13, 31, 32, 35: n = A,T,C or G
gnaaacccccggntacttatggcccggggtnnccnccgcaagccccatgtgtgttgagagcttttcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgcggcagttttaagttattaagtttttaaaatcagtactttttaatg

SEQ ID NO: 36394 - DNA, 366 bp, Homo sapiens
cagaagacacaacagaagacacagcagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactattcttgatgtaaaatcttgtcatgtgtataaaaataaaaaagat

SEQ ID NO: 36395 - DNA, 145 bp, Homo sapiens
agctgcatagatttcttcacctgatctttgtgtggaagatcagaatgaatgcagttgtgtgtctatattttcccctctcaaaatcttttagaattttttttggaggtgtttgttttctccagaataaaggtattactttagagtg

SEQ ID NO: 36396 - DNA, 472 bp, Homo sapiens
  misc_feature 24, 176, 177, 178: n = A,T,C or G
tatgaatacaggagtggaggctcnagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatgggnnnggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttct

SEQ ID NO: 36397 - DNA, 392 bp, Homo sapiens
  misc_feature 7, 30, 32: n = A,T,C or G
gagcgcncgggtgaggagctggtggcgtcntnttgttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtgcacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttca

SEQ ID NO: 36398 - DNA, 498 bp, Homo sapiens
  misc_feature 25, 177: n = A,T,C or G
cttacggaattacatcttgatggcnacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagctnaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaaataaataaaagctagatactgg

SEQ ID NO: 36399 - DNA, 427 bp, Homo sapiens
  misc_feature 153: n = A,T,C or G
gaccagcagactggcaacctcaagcaaggccctgctcctccagggctccaacgagatcgagatccgcgccgagggcaacagccgcttcacctacagcgtcactgtcgatggctgcacgagtcacaccggagcctggggcaagacagtgattgnatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatattttttttcctttgcattcatctctca

SEQ ID NO: 36400 - DNA, 394 bp, Homo sapiens
  misc_feature 25, 176: n = A,T,C or G
attcaatatatattataaattaatntaaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcnggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctga

SEQ ID NO: 36401 - DNA, 136 bp, Homo sapiens
  misc_feature 19: n = A,T,C or G
aaaggaagagtttattgtntctgcgttaaaataatgcacaatgaataaaaatgaaaaaataaataaaatatttaaagactggaagaaaaaatatattctcattttcagacaatataattatcacatactaaatccc

SEQ ID NO: 36402 - DNA, 393 bp, Homo sapiens
cacattcgggacacctcccaagctctggagcttacccagtatttttttgaggctgtttctacccagatggaaaagtggtatgaaaagtagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagact

SEQ ID NO: 36403 - DNA, 406 bp, Homo sapiens
tcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttga

SEQ ID NO: 36404 - DNA, 158 bp, Homo sapiens
  misc_feature 24, 25: n = A,T,C or G
aaataaatgaagaggcataccggnnttgtagattggaagacccaacatagtaaagatgtccattatcttcaaatttgaaatacaaatcaaacgcaattcctatcaaaatctaagcaagatatttttgtaggtatagacacatttattttaaaatttgt

SEQ ID NO: 36405 - DNA, 419 bp, Homo sapiens
  misc_feature 34: n = A,T,C or G
gtaaggcctaaaaagtgtaatggtccttttattntggcagcctgaatgagaatgcagggcattcatttcatgtagtatgatggtgattattatatgtagggtacagattggagtgttcagttttcctctatcaagatagtatttgaacacagggctgttagttaagaaaacgggttgtatttccacttaaaagagttaaatcttttaaaaagcgtaatacattttaaaaatcatgaatactgcattttgccctttaattggaaggatcaactaggaaactttggagagagaaataattttctaaatttacctcaagttaatatccattgtcttgagtggactcagatgtccctttcatggattgctttgaaacttggatttaggaaagatctaaactataagtagactgttcctatttg

SEQ ID NO: 36406 - DNA, 470 bp, Homo sapiens
  misc_feature 42, 51, 70, 221: n = A,T,C or G
tatggccggggatcccctaggagcctctctccctactgctgnttcacaagnaccctgagactgacctgcnggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcangagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactg

SEQ ID NO: 36407 - DNA, 198 bp, Homo sapiens
cataaagcaggggcagcaggacagaaagcttttattcttgtcaaaatcaatcttgactttggtacatcacaatggctgcatgacaatgtcacattcttgtccacttaggtaaatgtgtttggctcacttggccatcattctggaattaagagcctttgcagtataaaaccaagatttgaataacagtaaaggtcagag

SEQ ID NO: 36408 - DNA, 402 bp, Homo sapiens
  misc_feature 22, 27, 139, 174, 178, 180, 274: n = A,T,C or G
tgaaaggaatgctattaaaaanaccanctactttctcaaattgttttccagtgttctggagtctcactgtctctactttctctctaaaatacagaatgattgcatgcttacatacactatggaaacagtgatttagggngaattacaaaggtttcttctaagtatctacttggngggngncccattatgattcccttaacaagtaatacaggatacagcctttcttaaattcaccatgttaatgatcccctcatcccaccccaccccaatctgnctttcatataccatcaggtaggaccactatgctccaaaatatgcctttggaaaatgtatttattcaaatatctctgtttgtaaatgatgaaactaaaagaccccagagaaactaaatagctcccactg

SEQ ID NO: 36409 - DNA, 220 bp, Homo sapiens
aacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccatcagattgttgctgcacatagttgcctttgtatctctgtatgaaataaaaggtcatttgtta

SEQ ID NO: 36410 - DNA, 340 bp, Homo sapiens
  misc_feature 10, 231, 258, 270, 276: n = A,T,C or G
gttggagatngccaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaangagtcgaccctgcacctggtcctgcgnctgagaggtggnatgcanatcttcgtgaagaccctgaccggcaagaccatcaccctggaagtggagcccagtgacaccatcg

SEQ ID NO: 36411 - DNA, 472 bp, Homo sapiens
  misc_feature 12, 32, 36, 162: n = A,T,C or G
gaaacccacagnataataggaacaaaatgtantttnccatgtgccaaacaaaataaatgaaatctctgcatgtttgcagcatatctgccttttgggaatgtaatcaaggtataatctttggctagtgttatgtgcctgtatttttttaaaatggtacaccangaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgc

SEQ ID NO: 36412 - DNA, 484 bp, Homo sapiens
  misc_feature 7, 361, 421: n = A,T,C or G
ggcttcnccaaatgctacccaaataaccgcttctaattctctgtcatctgtccagcagcccttacagcaattgaactttcacccatgtgaggatcggcccaagcacaaaacaagaccaagtcattcagaagtttggggatatggattcctgtcagtgacaattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggnggattttacctacttttcttttttgaaagaatgctaaagatgttattaaagacatatggncagaatggtcatacccactttggaaatgataactttgggcctcaagaaaaaactcatcaacct

SEQ ID NO: 36413 - DNA, 425 bp, Homo sapiens
  misc_feature 24, 413: n = A,T,C or G
tcacttaccaggagcctcagggancccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgngagttaattaga

SEQ ID NO: 36414 - DNA, 325 bp, Homo sapiens
  misc_feature 24, 26: n = A,T,C or G
catactaaaacctttaaaaagctncntcttctcaattgatttttttcttttagaagccatggtgtctcaaccttttggggacctaacttctaaacattctaatagtttgccttaatttttcttctgctctcttactaaaaacgaagacattcaatactaatcttgctggaagaagccttaaccaagcaaacttctcatttctctggtgaaaactgctgccaaaaccacttgttaaaaattgtacagagcctgtagaaaatatagaagattcattggatgttggcctagttctgtgtggaagactagtgattttgttgtttttaga

SEQ ID NO: 36415 - DNA, 466 bp, Homo sapiens
  misc_feature 22, 173, 406: n = A,T,C or G
ctgtgtagccatgtcactgtgnataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgttnaaatgattcgcttttgtaagaatcagatggcattatgcttgttgtacaatgccatattggtatatgacataacaggaaacggtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgnggatatctaattctaaagtctgttccattagaagcaattggcacatctttctatacttta

SEQ ID NO: 36416 - DNA, 386 bp, Homo sapiens
  misc_feature 178: n = A,T,C or G
tgaagcgaaatttgaagatgacatcccctattggcttaacagagatcgaaatggacatgaatactatggcgattactaccaacgtcactatgatgaagactctgcaattggtccccggagcccctacggctttaggcatggagccagcgtcaactacgatgactactaaccatgactngccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttg

SEQ ID NO: 36417 - DNA, 198 bp, Homo sapiens
  misc_feature 23, 177: n = A,T,C or G
atatgtgaatgagtaacttattncgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtnaataaataccattttgcagcg

SEQ ID NO: 36418 - DNA, 327 bp, Homo sapiens
  misc_feature 323, 326: n = A,T,C or G
caggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtggganaana

SEQ ID NO: 36419 - DNA, 189 bp, Homo sapiens
tgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatg

SEQ ID NO: 36420 - DNA, 478 bp, Homo sapiens
tacttccgtaaaaatagttaatctatttttttttgacatcctagtttgcatcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccacgtgttctcggtcgccgtagacagcgctctggctaccaccgtgaggctacttgaactgtcaggggcatctgcctaaaccagaatcttttgtcagaaaccttaacccaacaaaacaaatcttgagtagc

SEQ ID NO: 36421 - DNA, 322 bp, Homo sapiens
caaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaatggtttactacct

SEQ ID NO: 36422 - DNA, 203 bp, Homo sapiens
tgtaatgcaaaatttttttaatcctcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcaca

SEQ ID NO: 36423 - DNA, 107 bp, Homo sapiens
  misc_feature 24: n = A,T,C or G
gtgttttaataggaagcagcttcnctgttttcatttattctcactgaggtgtgaccagtgtgtgtgtgtgtgtctgtgtgtgtgtgtgtgtgtgtgtgtgtgtgtat

SEQ ID NO: 36424 - DNA, 417 bp, Homo sapiens
  misc_feature 33: n = A,T,C or G
gaaaaccggctctctccctgtctgatctctttngcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatacttttataacaaaagggacagaagcattcctgctcttgtgaagtttacattgactagatagtaaacaaaataaatgaaatatgcagac

SEQ ID NO: 36425 - DNA, 237 bp, Homo sapiens
aggccgaggtgggcgaatcacaaggtcaggagattgaggccatcctgaccaacatggtgaaaccccgtctccactaaaaatacaaaaattagttgggcgtggtgggacatgcctctaatcccagctactggaggagctgaggcaggcaaatcacttgaaccagggagtcggaggttgcaagtgagccgagatcgtgccaccgcactccatcctggcgacagagcaagactctgtctc

SEQ ID NO: 36426 - DNA, 382 bp, Homo sapiens
  misc_feature 345: n = A,T,C or G
ctggataaattattatttatttcgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgtatttttcagttgngcatttattatgtatattttttgcataaaataacttg

SEQ ID NO: 36427 - DNA, 127 bp, Homo sapiens
  misc_feature 18, 22: n = A,T,C or G
tgcaaacagagcaaaggngacnaaattttatagtgaacagcatatacctaccatgtagactaccactaacatttcactatagttggcttatcacatgtctgtacctttctctaagcattcgtcaatc

SEQ ID NO: 36428 - DNA, 268 bp, Homo sapiens
gctggaaggaggctctcagatttccctgccctcctcacatcccccaaccctccctgggcgtgggggtgtcaagcatgagtcaggctgagcctgactctgaagctgttcccagctctttagtctaaacttcaaatcttcaaccctgttccctaatccaacacattccccaaatgaagggactggacagtgagatatcgggaaaccccatgaaaatagatgcataataaaggtgaaaatcatttaaaatgttcccatttttttttttttt

SEQ ID NO: 36429 - DNA, 364 bp, Homo sapiens
  misc_feature 23: n = A,T,C or G
tgtactccagcctgggtgacacnagagagactccgtctcaaaaaaataaaaataaaaataaaatacataaaggaaaagaaagaaatttttggccgggcatggtggctcacacggtaatcccagcactttgggaggccgaggcaggctgatcacctaaagttgggagttcgagaccagcctgaccaacatggtgaaaccctgtctctactaaaaatacaaaattagccaggtgtggtggcgcatgcctgtaataccagctactcgggaggctgagacaggagaatcacttgaacctgggaggtggaggttgcagtgagccaagatcatgccattgtactccagcttgggcaacaaaagtgaaagt

SEQ ID NO: 36430 - DNA, 420 bp, Homo sapiens
  misc_feature 314, 361: n = A,T,C or G
aagctgcagatccaggtcaccacctagaggggaggaagacctcgctttggagagtgggaataaaacgctcgtggagaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcgggngcaaaccagtgaacacctttgtgcacgagcccctggtagatgtccanaatgtctgtttccaggaaaaggtcacctgcaagaacgggcagggcaacttgctacaaga

SEQ ID NO: 36431 - DNA, 285 bp, Homo sapiens
cggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacag

SEQ ID NO: 36432 - DNA, 391 bp, Homo sapiens
  misc_feature 22, 175, 350: n = A,T,C or G
gaaatttttatctttattgtanacaccaaaagagatgtaactttgtttttgttttttaagttctccttgaaatataaaacttttgaaacaaatattagatatttagggaggtaagtaaagccatgtatatttgattccagatttaaaattacttagattatttaaaaattatctnactacatgtaatactttgtaaaaggcttagttttgtgtgatgatagtgatgtcttttatatttaaggaaagctactaaagttagtgaaacagtttcttctttcattcaaaattatttggtagatttaatgctttcttattttgtgcatttctttttaaatattttatattatggnaattctgctttaaacacagtttcatgtgttttggcaaacac

SEQ ID NO: 36433 - DNA, 428 bp, Homo sapiens
  misc_feature 24, 176: n = A,T,C or G
tcagttgtggcggttgctggtccntaacagccaagatgctgcggaatctgctggctcttcgtcagattgggcagaggacgataagcactgcttcccgcaggcattttaaaaataaagttccggagaagcaaaaactgttccaggaggatgatggaattccactgtatctaaagggnggggtagcttgatgccctcctgtatagagccaccatgattcttacagttggtggaacagcatatgccatatatgagctggctgtggcttcatttcccaagaagcaggagtgactttcagtcatcccagcaatcgcttggttcagtttcattcagctctctatggaccagtaatctgataaataaccgagctcttctttggggatcaatattttattgacttgtagtaactgccaccaataaagcagtcttta

SEQ ID NO: 36434 - DNA, 305 bp, Homo sapiens
tctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaaga

SEQ ID NO: 36435 - DNA, 146 bp, Homo sapiens
  misc_feature 23, 25: n = A,T,C or G
cgtctactgtgacagtatttcancntgtggacaaaagtagctttaaagcaagtatctggaaaatttttagcacacaggtttaaaatggtcctgcacgttgcaatacagcagcacgtgactcagagtcatgacaagggggtgtgata

SEQ ID NO: 36436 - DNA, 189 bp, Homo sapiens
  misc_feature 175, 178: n = A,T,C or G
tgagggggcaggcggagtttgacgaaaccgcagataagtttttttctctttgaaagatagagattaatacaactacttaaaaaatatagtcaataggttactaagatattgcttagcgttaagtttttaacgtaattttaatagcttaagattttaagagaaaatatgaagactnagnagagtagcatg

SEQ ID NO: 36437 - DNA, 309 bp, Homo sapiens
aacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 36438 - DNA, 499 bp, Homo sapiens
gacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgttcataaggaaaggttaaaaaaagtaaaaggaactcggcaaatcttac

SEQ ID NO: 36439 - DNA, 188 bp, Homo sapiens
  misc_feature 24: n = A,T,C or G
tccccttttcctctcctccctctnctctccagttaggctttccagagcacagtatatacactttgctgaaaattcgagtaattaggcctttccctcttaaatgtgatttttgtacagaatttggatgaggccgtttttttagatccctgaaatatgtgtctggtggaaataaattaacttttaaaaat

SEQ ID NO: 36440 - DNA, 329 bp, Homo sapiens
  misc_feature 245: n = A,T,C or G
atgcaatccctatcaaaatctcatcagcattcttcacagaaatagaaaaaaatcatacaatttctgtggatccacaaaagatcccaaataaccaaagcaattctgagaaaaaaaaatcctggaggcatcatacttcccaatttaaatttatattacaaaacgagagtaatcaaaacaatacagtattggcataagagatacacaggacagtgaaatagccagaaataaatccaaacatgtatggntaatgaatttttgacaagagcaccaaaaagacaaaatgagaaaagggtagtctcttcaataaataggtgctggaatttccacat

SEQ ID NO: 36441 - DNA, 479 bp, Homo sapiens
gtttgaagtgactttcaaaatgtgtgccttgtgctttaggataaagcaatccaatgaattattttttgtacttctttatgctactatttacatatgaaataaaactaattggcttctgtctatactaacccagagaagttactggatctgtgtagagctgtcatggcaatcaatagcaatcatttatttattccctttttggtttttcatcaataagcagattagactttttgaagcagctgccacctggcttcaggttggggtcattcttttcctgatgtatttatggtaatgaaaatgaaccttgtcaaaatgatttataacttttaaatcagacagttggaggaaatagcttgtaaggttatgtggcattccctaaaaataattgcatgatacattatatattttatcattgagttgaatccaaagctcttactttttattgtaagtaagaaaaaaaaggaatacaagttgaatat

SEQ ID NO: 36442 - DNA, 194 bp, Homo sapiens
  misc_feature 158, 165, 188, 194: n = A,T,C or G
aacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttngtatatnatgggtaacaataaatatacatngctttn

SEQ ID NO: 36443 - DNA, 386 bp, Homo sapiens
cttataaactgtgtactcttctcattaaacaatacagtcaatacaatttaacttttgttttcttaaaatgtatttcaagatttggaatcattatgagcatcagtttttgccttgccgtgcttaatgtgttgatgtcctctggtgctttggaagtattcaagctgtttggtagaatgattttgccaaatagctcttagtgaactgctactgattcactaatttactgcttttatttgttatatatgggaaatattaggttgtctaaagcaaatcaaaataaaaccagaaatcatctctgatgattctaaaactagaaatcagggacaacttcttggtatagtttgagagacagattgagtgaacattgtaatctggtgctatatatt

SEQ ID NO: 36444 - DNA, 486 bp, Homo sapiens
  misc_feature 10: n = A,T,C or G
ctccccggantgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcaccggtttttggcaaagtagggggcacatttccattatagcaatgttagtgccaccaccttctgaacacagtggggagggctgtgaaggctcatgtgacctggatctgaggtctctgatagaaatctggacgccaccgggtcca

SEQ ID NO: 36445 - DNA, 310 bp, Homo sapiens
  misc_feature 6: n = A,T,C or G
aggatnaaagaagaatagagagctttcgagttaacagggaaaataaggactttgtgccaaacatttccaaatgtggaatttgagaataatctcaaatctaagattgtagttatttggatttttaaaattagtacttagttttccacacctttgggaatttcacccttgatggaggattgcaagaataatctgatttttcagaacagaaggacagtctgtctcaaaggtaaattccaggttctaccatggagaaatagaaattgctcccaactttccaaaaggttcttaagttctttcttcttttgtggtt

SEQ ID NO: 36446 - DNA, 470 bp, Homo sapiens
  misc_feature 2: n = A,T,C or G
gngaccctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactct

SEQ ID NO: 36447 - DNA, 490 bp, Homo sapiens
gagtgaaactcgttttggactccgtcagaggtataattgtacaaagaatgcccacatgacagtaaatgagaatttgaaacatgaggcagtttcaaaatgaggcaacttctgagacttttagaaaagaggtttttttggagaaaaggaggagactagacctttatcagtatcagtaaattcttacacttgaaatgttctgaccagatgttttaaaagttaaaaaaatgtttaactccatttttcctttgtacatggaaatcagttgcatgcgaacagggcatatcctctttgctgctctgcctcctgcacttcccacagagcaggtcattagaagttaacatgcagaacactcaaggtgaaaaggcttgtttttcggtgtttctgacagctttatcagggctttaaggaaacgctgaattttgtccttagccaattgaaatgaagacacatgtttgggtcagaaaattggtcaaattatgaacacgtttag

SEQ ID NO: 36448 - DNA, 464 bp, Homo sapiens
  misc_feature 12: n = A,T,C or G
gttcaccaaggnaggacctcactgagatcagggacatgttgctggccaataaggtgccagctgctgcccgtgctggtgccattgccccatgtgaagtcactgtgccagcccagaacactggtctcgggcccgagaagacctcctttttccaggcttttggtatcaccactaaaatctccaggggcaccattgaaatcctgagtgatgtgcagctgatcaagactggagacaaagtgggggccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggtacccaactgttgcatcagtaccccattctatcatcaacg

SEQ ID NO: 36449 - DNA, 136 bp, Homo sapiens
  misc_feature 15, 60, 71, 136: n = A,T,C or G
atggcccgggaaaancatgttgataaaattgaaacatttggttgtggaattgtgtgtggntttagagggtntctgtttgtgaaatgtatgtattaaaaataataaaattccagaaactagcaaaaaaaaaaaaaan

SEQ ID NO: 36450 - DNA, 439 bp, Homo sapiens
attgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatg

SEQ ID NO: 36451 - DNA, 325 bp, Homo sapiens
cagtgacccttgtttaaaaataataatttatcacattgaaactttcagctctgtcgaatgatttctgaattacatcctgtgtttcagcttaggttgtaaaatactccgttctctgtggagtcagcatatttgagagggcagcgttttgccagtacctatcttctttctacagaagatagctttttaagaaataagagttccacattgagtggctgtcagacacagatttcactgtgacgtaaaatacactgcagtgagaatatggtatcaccactattcatatttacatcattcccctcacacagaaaaaccaacccttttccca

SEQ ID NO: 36452 - DNA, 469 bp, Homo sapiens
  misc_feature 6, 255, 266, 295, 309, 311, 427, 448, 455: n = A,T,C or G
gaaaantcaaagtgagagaactataaagggtttttaaaaaggaattaggtatgttgggttagtcgcattggagagtgcaaattcaccatcgacctgatacctgaaatttcctccttaccatctagaggcaagttgggaatgctgccaggctcctgtggtaaaggaagctcctctcttgactggtgctttatggctacacgttcctgctcagaatggatctcatttagtcttcaccaaaaaaaaaaatctcatganatgatttaagngttttatggacaagatgtctaaaactcanaaaaatttcacagngngcctagcttttatgtttatgttgaagttgggcattagaagttagaatgaatgggtttactttcagagaaaattaaatccatcacccactccttgtactatgaattccaaatacatnttaaatacatataataaaatntttaatntatatgtaaggtgc

SEQ ID NO: 36453 - DNA, 478 bp, Homo sapiens
  misc_feature 40, 121: n = A,T,C or G
gctaaacctagccccaaacccactccaccttactaccagnacaaccttagccaaaccatttacccaaataaagtataggcgatagaaattgaaacctggcgcaatagatatagtaccgcangggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagaga

SEQ ID NO: 36454 - DNA, 454 bp, Homo sapiens
  misc_feature 112, 277, 293, 324, 388, 431, 434: n = A,T,C or G
ggcctttgcccgccttggcggccggctctacgttccctgttctcgcctgcagctccgccatggctcctaaaggcagctccaaacagcagtctgaggaggacctgctcctganggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggnagcctttgcatacaanaatgtgaaatttgttctcaagcacaaagtancacagaagagggaggatgctgtttccaaagaagtgactcgaaaactttctgaagctgataatanaaagatgtctcggaaggagaaagatgaaagaatcttggggaanaanaatgaagttgctgattatga

SEQ ID NO: 36455 - DNA, 488 bp, Homo sapiens
  misc_feature 17, 216, 460: n = A,T,C or G
ggggtgctgctagcggnggcgccatattggaggggacaaaactccggcgacagcgagtgacacaaataaacccctggacccccttgttccctcagctctaagggccgcgatgttgtacctagaagactatctggaaatgattgagcagcttcctatggatctgcgggaccgcttcacggaaatgcgcgagatggacctgcaggtgcaggaatgcantggatcaactagaacaaagagtcagtgaattctttatgaatgcaaagaaaaataaacctgagtggagggaagagcaaatggcatccatcaaaaaagactactataaagctttggaagatgcagatgagaaggttcagttggcaaaccagatatatgacttggatctttggaattagacactccttcacagccagtgaacaatcaccatgctcattcacatactccagtggaaagtaagtttggngtagtgcagctaagttttaaaaacaatg

SEQ ID NO: 36456 - DNA, 489 bp, Homo sapiens
ctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttca

SEQ ID NO: 36457 - DNA, 271 bp, Homo sapiens
  misc_feature 4, 5, 18: n = A,T,C or G
ggcnnaagctccttgccntctgctaagaaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgaggcaggagactcgcttgaacctgggaggtggaggttgcagtgagccgagaatgccactgccctacagcctgggcgacaaagtgggactgtct

SEQ ID NO: 36458 - DNA, 475 bp, Homo sapiens
attcttagctttcttaggtgaaccacacatttatacttggaaatcatttgtaaatgtgtaatcacttctaattttgctacaagacgggtgagtggcctagtaaattagcttaaccaatttcacatatcagaccagtaactcactagactcttagaaaattgggatacttctaaatgtctctgaaagagccctcattaaagtatccagtgtgtcctgcctccttgaattagccattcctcgttcacataacaggtgtgagaaaggataccaaactatgactccaggtaacaaagtacagacactgtgttttgtttatcattttatgtctttctgtttacttaaaaaatgcagtgctttttggacggggtgcgatagctcacgcctgtaatcccaacactttgggaggccaaggtgggcggatcacgagatcaggagatcgagaccgtcttggccaacatggtgaaaacccatctct

SEQ ID NO: 36459 - DNA, 486 bp, Homo sapiens
gctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcaagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgccttttggaaagccccagggcactgtggccaagggttcacattggccaagttatcatgtccatccgcaccaagctgcagaacaaggagcat

SEQ ID NO: 36460 - DNA, 464 bp, Homo sapiens
actcattatgacacagctgaacatagaataaatgaactggaagatatagcttaagaaattactcagaatgtagcacagagaaatgagaaaatggaaaatagatgtaaattaagagatatgatggatagaatgtcaagctcaaatacacatcaaattgaagtcccagaaagagagaataaacagagaagtcagatttgaagaggaatggctgagacatttttaaaactgataaaagaatccatgattcaagaggtgtaacataatctaagcaaacaaagaaattgacacctagacaaataataaaactgcagaataacagtgacaaagacgtgaagagcagtcagaaagaaaagacagtttacctacaaagaaatgacaaacgagctgattttttgataatgagcccaggtagataatatttttagaagcaataactgtcaccctagaactggggaactagtcta

SEQ ID NO: 36461 - DNA, 490 bp, Homo sapiens
gggagtcctgcaataaacatatgtgtgcagtgcctttatagtagaatcatttatattcctttgggtatatacccaggctgcatgcagtggtgcgatctcagctcactgcaatctccacctcccaggttcaagtgattctcctgcctcagcctccagagtagctgggattacagacctgcactaccacgcctggctaatttttgtatttttttattagagacggagtttcaccatgttggccaggctagtttccaactcctgacctcaagtgatccgccacctcagcttcccaaagtgctgggattacagacatgagccacagtgcccaacctgtgatatttttgtctttgtcagactttcctccttttcccagtatctccttcctcattattactcttccttcttcatcctttggtctccccactcagtgcccctatccctcttcctctttcatcactgtgttccaatttatacaaggatctaaaactga

SEQ ID NO: 36462 - DNA, 399 bp, Homo sapiens
  misc_feature 12, 176, 201, 208, 221, 300, 354: n = A,T,C or G
cagaacagcagnactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatgnacagttatctaagttaatttaaagntgtgtgngcccttttatttntgtttttaatgctttgatatttcaatgttagcctcaatttctgaacaccataggtagaatgtaaagcttgtctgatcgntcaaagcatgaaatggatacttatatggaaattctgctcagatagaatgactgnccgtcaaaacagattgtttgcaaaggggaggcatcagtgtccttg

SEQ ID NO: 36463 - DNA, 114 bp, Homo sapiens
ggacttggccaaggtcagagctcacctgggaccacacgaagatgataacttgctaggagttttgcaaatgggtttgtctacagtttggtagaattaaaacattgtttttagttc

SEQ ID NO: 36464 - DNA, 142 bp, Homo sapiens
  misc_feature 31: n = A,T,C or G
gatatatttcatttgcaacttctacataatnagttttatgtttaaaaccatcggttctatatatctagctttaggaagttgcccttacaggtgggaccttttgtgttaatctgttttctccccagtcatcttatttggctat

SEQ ID NO: 36465 - DNA, 322 bp, Homo sapiens
cagtccattatcatgtctatgaaaatgtctcccaggttggggccactcaggtttgcaggcttccaaacctcacaataactcctttgagaggtttgaaatgaaggaacataaggagctatagctgggaggaaatctcttttcttccctctttaaaacatggatggggaacatcacacatgaaggcttaatcctgcccttccttagattcttgtcacacctatttagcaatgatgctgttcttattttatggatacaggtcagagtacttatcaaacggtaccatactaaggcagagcattttttctgaggcatttagaaacta

SEQ ID NO: 36466 - DNA, 261 bp, Homo sapiens
gacggggaatcagggttcgattccggagagggagcctgagaaacggctaccacatccaaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcac

SEQ ID NO: 36467 - DNA, 483 bp, Homo sapiens
agagtatgtgagcaacctgtcttcagtgtagtacaaaggcagagtgagggggcttgtggctccttccaaccccactccccgttcagcacagccgccatttgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattaggtgtggtcaagagccgtctgagcctaatgagtcccagctacattaggttaagagactcttccagagccagcgccaggtcctgaatggcacctctccctaggatacacagcctgcaggtccccaggacctggatgacacccgcctcactgtggcagtgtattgcctgttaattgctgctaattctaattctgatgatgactcctactccattgtttacccc

SEQ ID NO: 36468 - DNA, 462 bp, Homo sapiens
ggggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtcctgttctgatttgggtctggacaaagtgccaaaggatcttccccccgacacaactctgctagacctgcaaaacaacaaaataactgaaatcaaagatggagactttaagaacctgaagaaccttcacgcattgattcttgtcaacaataaaattagcaaagttagtcctggagcatttacacctttggtgaagttggaacga

SEQ ID NO: 36469 - DNA, 464 bp, Homo sapiens
agaattagaatttctgaagaatattttgttcagataattaaattttaaaaaatagtgtatcttgtcatttgcacataagaattattttaatttttatttaaggatttgtttagcatttggattccctctcattccttgtgtgtgtctgcacgtgtgtgtgtgtatttgtgtgtgtgttttaaaaataaactcaaatgcaactcttcttgtttctaacatctttccagattgtactggaatagtgtaacatgattaaccagtatgtacatttctcctattttacaatgttgaatctcttattgctcccacttttctagttccctcattctcagtgctttacagccaaagctgtatttttgcaccttggtacaattttattcatctcaaataagataggctttgaaaaaacaaccatatgtaataagcatcttctactttgagatgccttgctgaacatgtagatg

SEQ ID NO: 36470 - DNA, 189 bp, Homo sapiens
gggcaaaaaaaataactgacagattagaaaggaagaaataaaactttgtttgcaggcatgattgtatagatagaaaactaaagaaaagctactggaactaatgatcaaatctaaaccattttctggatttttacatactagcaaagaagaattggaaattgaattttaaatgtcatttataataggatc

SEQ ID NO: 36471 - DNA, 471 bp, Homo sapiens
  misc_feature 110, 206: n = A,T,C or G
gaccctaaccaaggctgcactatggatgctatcaaagtatactgtgatttctctactggcgaaacctgtatccgggcccaacctgaaaacatcccagccaagaactggtntaggagctccaaggacaagaaacacgtctggctaggagaaactatcaatgctggcagccagtttgaatataatgtagaaggagtgacttccaaggnaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatca

SEQ ID NO: 36472 - DNA, 459 bp, Homo sapiens
atgggaagatagactggtattttaaaactgtaaatttaaatttacatgtagaaattagtggtaatcactgtgtgctaccttataagagaaaaatccacttccattttatatttgtgaccacatgactgaaccatgcatactaatcagtatggtttcttggattcttgccatgaagttgttaggacgaagaagaggaggccacacagtggctgcttccttgcttgtgctgggagagaagaactcagcagttgtaactcactgtaactctgcttatcctctgctttctctgttttcccgtatggaggggtagacatggaaagaaaggcagatcatgattaaaggttacagaaggagaagtagcaaggctttaatcctagagcccatcctcccagagaataaatggtaaaaatgtttgcctttgtgccttgggaagcgctaggctcctgctgctctttcatg

SEQ ID NO: 36473 - DNA, 442 bp, Homo sapiens
cactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacat

SEQ ID NO: 36474 - DNA, 239 bp, Homo sapiens
  misc_feature 26: n = A,T,C or G
accctcagcggatgataatctcaagnacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatac

SEQ ID NO: 36475 - DNA, 465 bp, Homo sapiens
cattccagtctcttggaactttaaaccttcatgaaagttaagtctagaactaaagagaatctcagtgacatctaagtgagctaagttgttagtctcattttaccaaggatattacctgaggagactgtaactgcttttatattctgttactacctccatgcaaagacccacagcagctctgtgaagcatttcatttatataaaataacttctttaagtttatgtagtttagtttaaaagattcattgaagcccctcctctgagcctttgagttaggttccaagagcatatatgggaataacattacttcctgctcttaagaaaactcacataaacagatcattttatggttaattctgagaggcacgcatagaatatcttagaacacagaggaaagttactcagactaacttagagcttaagtgactacttcttggaaatgacattctgagctcaaaagatggtt

SEQ ID NO: 36476 - DNA, 489 bp, Homo sapiens
ctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaaatatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagaga

SEQ ID NO: 36477 - DNA, 419 bp, Homo sapiens
acaaactggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgaga

SEQ ID NO: 36478 - DNA, 408 bp, Homo sapiens
  misc_feature 341, 343, 362: n = A,T,C or G
aagagatggaaggtggcggtgggggggtgtctcgccatgttgcccaggctggtctcgaattcctgacctcgggttatccacccgcctcggcctcccaaagtgctgggattacaggcgtgagccaccgcgcctggccagaagaaatctttatcttggtgtgcagtctctggtgagggacaaatgtcatctctcttggatctgaatctggaaggataaaggcactgaagggatttttttgtttcgggcagtctccttctgttgccaggctggagtgcagtggcacgatctcagctcactgcagcctctgtctcccaggagaatcgcttgaacttgggaggcananattgcagtggggagctganatcgcaccactgcattccagcctgggcgaccgagcgagagtctccc

SEQ ID NO: 36479 - DNA, 470 bp, Homo sapiens
  misc_feature 209, 467: n = A,T,C or G
gaaatttacatttgatgttatcttttgatgttacctttgagttccatgttatttttaatatcttctgtttctctcatattcatgttttctttacattcttgcgcatatgaggcatacttataatagctggattattggattatgcccagtagttaagttgggaatcattattgttcagttgagacttatttatttttttcatacagagncactctcaggataagttgagacttatttgtcagctcttttagggatggtctagaatagcatttgttctgtggctcatttagccctgctcctaaaggtgtgtctcgctctggtctctgctgaatgtgttacatagtcattgaggtcttgccactctggctaaagacaatacagttggctagagacaatacagttgattcgcagctttctgtgagctctgggaattgttcttctgtaattgctctctccctggaagttgntct

SEQ ID NO: 36480 - DNA, 236 bp, Homo sapiens
gggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtg

SEQ ID NO: 36481 - DNA, 465 bp, Homo sapiens
aggtgacaaagagggagctctgacagcctttcgcaagtacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttact

SEQ ID NO: 36482 - DNA, 464 bp, Homo sapiens
gtggtgagctagggggatggatgtcataatggtgagatcacaaataccagtgtgaaagctttcctgaagaagaggtcagagaaaatggtctattccttaaatgaatgcttgttacattaatataccttcctgtcatttaaatattgtcctcagagtgatcaaaaaggtcatggcctgtgggtctttactgctaatgctacttccttcctcatttttagaaaaattactgttaatagaaatgatacactcactttctttaacatgatatttctatatttaaaaagagcataagaaaccattaacgtttaatttatgattcccacttgtcattctaatttatatttttaaagatttacattattttgagtaagttctaatcctatgaaatgatgcagatgtcaccaacaacttaaattcaattctgatcttatactaatacataattctaaatatattactttgag

SEQ ID NO: 36483 - DNA, 417 bp, Homo sapiens
agtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaac

SEQ ID NO: 36484 - DNA, 157 bp, Homo sapiens
atcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcat

SEQ ID NO: 36485 - DNA, 469 bp, Homo sapiens
ggggcggggaatctgagtaggagtggtgcctttcttatcccttgtcaaggtcctcagttgaagacagggcacagagaggggtctgcacctggttagctcctggcctactgaaggaatagacatttgtgtgaatagattacagatctctgtcttggatacacggagatgtccccacctagttgggggtcttagatcctggcccattgagtaggaaaagaccggcattgggatacttgcacaaggagtaattacaccaaactcaaagaaagcttagcatttatggaagggaggaaagacacggaggtgccaggtagggtgtttaaacaaagatctaagctagctccaaagtcctgattttgatctttaatttgcatagtgcacgaaatgatgctgttctgcacaagatgacaaggaagatgtttgtggggctgctttgctttgtacttgccatttgcatgtgtcagcttac

SEQ ID NO: 36486 - DNA, 348 bp, Homo sapiens
cttccttgatattgcacctttggacatcggtggtgctgaccaggaattctttgtggacattggcccagtctgttccaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaag

SEQ ID NO: 36487 - DNA, 443 bp, Homo sapiens
  misc_feature 213, 417: n = A,T,C or G
aaccattttttaacctgttcgaagaagccagtataggttcaccaattatacttaattaaacagttgtctttttcccttcctgtcttgtttgaatatgtaagtacttgtgttagtcacctaaaggattatttaaaatttaaatatttaataaaaaatgcagtattaatgtttttggataaaatactaggaaaaaaatgtacttgcttagctagnttgtactattgggggtattcgaaaggcaagggagtactgcctaaaatccagctgaaacgactactagagttggtgaagttttataaggggaggtcttttattgctcagagttgggtggtgggtggcaagagtaggagaacatttggatattaatgtgtcccttagaaattgaagtatattcatgtacttccctttctgtactgngatttttatatgtatgtattaaattg

SEQ ID NO: 36488 - DNA, 437 bp, Homo sapiens
gtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgatttttttttttaacatgtattcagattgag

SEQ ID NO: 36489 - DNA, 185 bp, Homo sapiens
gatgaagccccatctctgctaaaaatacaaaaattagctgggcatggtggcacacgcctgtaatcccagctacttgggaggctgaaacaggagaatcgctggaacccgggaggcggaggttgtggtgagccaagattgcgctgttgcacttcagtctgggcaacagagcaagactccatcttacc

SEQ ID NO: 36490 - DNA, 462 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacat

SEQ ID NO: 36491 - DNA, 333 bp, Homo sapiens
  misc_feature 18, 26: n = A,T,C or G
atcctctctaaaaacagnaaacaagnacaaggatgcccactatcaccactcctatttaacatagtactggaagtccaagccagaacaatcaggcaagataaataaaaggcataaaaattggaaaacaggaagtcgaactatccctgttcattgatgatatgatctgatacttagaaaaccttaaagactcctctcaaagacttctagatttgataaataacttcagtaaacttttgggataaaaaattaatgtacaaaaatcaatagcatttctatacaccaataatgatcaaactgagaaccaaatcaggaattcaatcacatttacagtag

SEQ ID NO: 36492 - DNA, 455 bp, Homo sapiens
  misc_feature 33, 212, 317: n = A,T,C or G
gaacacatccaagcttaagacggtgaggtcagnttcacattctcaggaactctccttctttggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggnggagttgcctcgggcagccttgtggctactctgcagtcactgggagcaactggactctccggattgaccaagttcatcctgggctccattgggtctgccattgcnggctgtcattgcgaggttctactagctccctgcccctcgccctgcagagaagagaaccatgccaggggagaaggcacccagccatcctgacccagcgaggagccaactatcccaaatatacctggggggaaatatacc

SEQ ID NO: 36493 - DNA, 214 bp, Homo sapiens
  misc_feature 1, 9, 34, 35, 36, 94, 212: n = A,T,C or G
naagaaccngtcctgggcaacgtaggaaagactnnntctctacatagcaaattttattataaaagtagctggggatggtggcacacacctgtangtcccagctactcaggaggttgaggtgggaagattgcttgagcccaggagtttgaggttgcagtgagctgatcatgccactgcactctagcctaggctacagagcaggaccccatctncg

SEQ ID NO: 36494 - DNA, 316 bp, Homo sapiens
  misc_feature 32, 209: n = A,T,C or G
cagggaagaattcttatctctagcttggtttncacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatattnaaaatgagagacattttgtaaccctgtaaaatacatagggaatataacattccagtgtatacaaagaaggcaaattctttaatcaaataaagcgcattataaaatgc

SEQ ID NO: 36495 - DNA, 445 bp, Homo sapiens
  misc_feature 20: n = A,T,C or G
atagtaccgcaagggaaagnatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccact

SEQ ID NO: 36496 - DNA, 437 bp, Homo sapiens
ggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgacccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttg

SEQ ID NO: 36497 - DNA, 317 bp, Homo sapiens
  misc_feature 4: n = A,T,C or G
cagnaaaggtctggccagccaaggccttgaggactccagtggcttttccccagctgaacaaatcctgtggaatcttacaatgtaagcaacagaccccgaggaaagacatccatgctaattaactaatgacaccggaaacgtcctgaggtgcgggacgggctgccgcctgcctatctctcagaaattaaccaccccgctacaattctgtggatgccagagcggagacggctactacacaccaggaaagtctggttgaaaaatgtctgaaagtcagtgttttcgctgctattcctaaaataaaatacttgaaattccgg

SEQ ID NO: 36498 - DNA, 440 bp, Homo sapiens
  misc_feature 84: n = A,T,C or G
gctttccaacttggaacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgg

SEQ ID NO: 36499 - DNA, 282 bp, Homo sapiens
ggactaccgtgaggatggtgtgaccccatatatgattttctttaaggatggtttagaaatggaaaaatgttaacaaatgtggcaattattttggatctatcacctgtcatcataactggcttctgcttgtcatccacataacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacacg

SEQ ID NO: 36500 - DNA, 362 bp, Homo sapiens
  misc_feature 10: n = A,T,C or G
aatgctaagnacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacaccca

SEQ ID NO: 36501 - DNA, 470 bp, Homo sapiens
atttcaaatgaggtctatgtggaatccagtctctgtatcaagcaggcacatgtgccacatagttctaagggaagtagcgtggagaacaactgggctccttctgtccagggcccctccttgccccatcagacaccccaacaaaacagagccactagaaaaccactgccttggatgacccctgaggcctctcactgctctgacctcccaggacaaaggccagcaaactgtggccagtgggctgggtttagctgttctcatatggcccatcacttaagaatgatttttacattcttaaatagttaggggcaaaaagtcaaaagaaaaataatattttgtgacacatgaaaattatataaaattcaaatttcaatgtccacaaataaagtttgattggaacaaagccatagccatctgtggacaagttgtctatgactaactgaggacaatcacagcgaggttgaatacagtca

SEQ ID NO: 36502 - DNA, 355 bp, Homo sapiens
ggtccatggtgattgtgtacgatttaattgattcgatgcaacttcggaggcaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcaccta

SEQ ID NO: 36503 - DNA, 492 bp, Homo sapiens
  misc_feature 2, 9, 23, 35: n = A,T,C or G
ancgacagntaaatgtcatatgnaatttactccantagccattacactgatgggctgaggtagccactaaaaatgaaagctacaggaacgattaatacagtatagtacagtatgcatatggtgggaccatgtggtttatttcattaaaacatattagtccctgctattttcctctctttggtggccaagtcttaactttcagctgtaagctcagtcttaatatatttttccaaccttgtttatcatccgtgtataatcagcgattataactggttcccctgttttctagcattgaaatgccatccagtcattcacatctcaagggtattgtgtatacaagttatgttacttggcagtttaaagttacatatgcatgtatttttatcttgagcaagcaaagaagcaggctcactggaagccctctttgtgaaggtccactggtttgacttggagtcaagagggctagtgttcattgtcagctctgtggctcac

SEQ ID NO: 36504 - DNA, 162 bp, Homo sapiens
  misc_feature 28: n = A,T,C or G
gaggcacctaaaaattgtataccgcagnattcaggcatggattccgtgaaggaacaacacctaaacccaagagggcagctgttgcagcatccggttcatcttaagaatgtcaacgattagtcatgcaataaatgttctggttttaaaaaataaaaaaaagcg

SEQ ID NO: 36505 - DNA, 182 bp, Homo sapiens
gaagttgcaagttttgatagcccgtgaagtgcataagtatctaattttacctgaattgatttggggggaaattaccagtagaatgccttggtctgaatatttgatagaaccaattgttgtacgtaaaacagatctgcgcatatatatatattgtataaaaaataataaaataatggaagatg

SEQ ID NO: 36506 - DNA, 471 bp, Homo sapiens
gaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtaccgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattg

SEQ ID NO: 36507 - DNA, 398 bp, Homo sapiens
  misc_feature 40: n = A,T,C or G
agcagaatggaatgaaccatccatcaacttctataaaagnaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattct

SEQ ID NO: 36508 - DNA, 215 bp, Homo sapiens
  misc_feature 38, 39, 60, 61, 212: n = A,T,C or G
tatggccggggatcgcttctcggccttttggctaagannaagtgtagtatctgttcttanncagtttaatatctgatacgtcctctatccgaggacaatatattaaatggatttttggaaataggagatggaataggagcttgctccgtccactccacgcatcgacctggtattgcagtacttccaggaacggtgcactctcccttcggggngag

SEQ ID NO: 36509 - DNA, 471 bp, Homo sapiens
aacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttc

SEQ ID NO: 36510 - DNA, 438 bp, Homo sapiens
  misc_feature 20: n = A,T,C or G
aaatgaagtgattctaaganttggtttgggatcaataggaaagcatatgcagccaaccaagatgcaaatgttttgaaatgatatgaccaaaattttaaagtaggaaagtcacccaaacacttctgctttcacttaagtgtctggcccgcaatactgtaggaacaaacatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattattggtggggtgattatttttttatactgtatgtgccaaagctttactactgtggaaagacaactgttttaataaaagatttacatt

SEQ ID NO: 36511 - DNA, 297 bp, Homo sapiens
ggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattatta

SEQ ID NO: 36512 - DNA, 142 bp, Homo sapiens; identical to SEQ ID NO: 23637

SEQ ID NO: 36513 - DNA, 313 bp, Homo sapiens
  misc_feature 2, 6, 312, 313: n = A,T,C or G
antganaaaatttctacttaataaattggagctgggagcagtggctcatgcctgtaataccagcactttgggaggccgaggggggcggatcaactgaggtcgggagtttgagaccggcctggccagcatggtgaaaccccgtctctgcaataaatacaaggattggctgggcatggtggcatgcacctgtgttcctagctgctcgggaggctgaggcgggagagttgcttggacccaggaggcagaggttgcagtgagccgaagtcgcgccactgtactctagtctgggcaacggagtgagactccatcgcnn

SEQ ID NO: 36514 - DNA, 134 bp, Homo sapiens
atctctggttgtaccaaagaagaataaatatggtttcttaatctcttgcatgttttcttataaataatcatgttcaatgaaaagaagttactgagcttatttagatacattaaacattacttaactactggttc

SEQ ID NO: 36515 - DNA, 474 bp, Homo sapiens
agctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcact

SEQ ID NO: 36516 - DNA, 148 bp, Homo sapiens
  misc_feature 23, 30, 74: n = A,T,C or G
tatggccgggaaccgctattctntgtggantacaaaatgcctttttctctgaattaacctgcatttgaaaatantttagtatgtgtgaaaataaaggaattactaaatcagtaggaaagatgttcaggtaaaggcatcatcagtcagc

SEQ ID NO: 36517 - DNA, 130 bp, Homo sapiens
  misc_feature 3, 16, 39, 42, 51, 52, 54, 70, 79, 85, 88, 94: n = A,T,C or G
gangcctgtgggggancctgggcacctgtgggtttcccngcnatgaaagannantgggcttgggcgggtnccttgggancgtacnaantacccnactttcccgcttgtcaccgggtaaaaagtcccgccc

SEQ ID NO: 36518 - DNA, 479 bp, Homo sapiens
  misc_feature 23, 36, 42: n = A,T,C or G
tatggccgggagacattctcacntaagcccggttcntcaccntttcctcctttacctttcagtgcagtttcttttcaccttaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatc

SEQ ID NO: 36519 - DNA, 137 bp, Homo sapiens
caatgatggtttaataggtaaaccaaaccctataaacctgacctcctttatggttaatactattaagcaagaatgcagtacagaattggatacagtacggatttgtccaaataaattcaataaaaaccttaaagctg

SEQ ID NO: 36520 - DNA, 471 bp, Homo sapiens
tctgcctcccgggttcaagtgattctcctgcctcagcctcccgagtagctgggactacaggtgtgcgccaccacacccagctaatttttgtatttttgttagagatggggtttcaccatgttggccaggatggtctcgatctcttgacctcgtgacccacccgcctctgcctcccaaagtgctgggattacaggcgtgagccactgcgccctgccagagtaataaaaatttttaactgcatgcaatttttaactagatgcatcactggctcaatttctgcaaaccaggtgggtggctgagtgggtggatggatatggttgccttcccttcacttgtggcctaagaaacaggatgtttccccactgggtttttttcaacaagcctttccttcaccttggggctcatttttcgtacagttcatagcacatttgttgtctgcctcaactcctgccacttctaaggaccaatagc

SEQ ID NO: 36521 - DNA, 352 bp, Homo sapiens
aatggccggggctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaagggggac

SEQ ID NO: 36522 - DNA, 250 bp, Homo sapiens
  misc_feature 7: n = A,T,C or G
tcattcncccttttgggctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagc

SEQ ID NO: 36523 - DNA, 469 bp, Homo sapiens
  misc_feature 463: n = A,T,C or G
gaagagaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtgggaaggggcaggattctgcagctgcttttgcatttctcttcctaaatttcattgtgttggatttctttccttcccaataggtgatcttaattacctttcagaatattttcaaaatagatattattttttnaaaaat

SEQ ID NO: 36524 - DNA, 180 bp, Homo sapiens
  misc_feature 31, 32, 33, 35, 36, 37, 40, 50, 68, 94, 98, 115: n = A,T,C or G
tatggccgggcaagaagccctttatcaagtnnntnnngcncctctactgngtgccggataatgtacanctgaaacccattgcacagagattgangagngggcatggaaataagantagagacatggtctttgccctaataagagagctagaaattaaatgtttaatacacagttttaatt

SEQ ID NO: 36525 - DNA, 171 bp, Homo sapiens
agatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgc

SEQ ID NO: 36526 - DNA, 273 bp, Homo sapiens
  misc_feature 8, 170, 184, 202, 253, 265: n = A,T,C or G
gtcgcggntcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggntgatctttgctggnaaacagctggaagatggncgcaccctgtctgactacaacatccagaaagagtccactctgcacttggtnctgcgcttgagngggggtgt

SEQ ID NO: 36527 - DNA, 271 bp, Homo sapiens
  misc_feature 13: n = A,T,C or G
tggacatcttgtnaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagc

SEQ ID NO: 36528 - DNA, 125 bp, Homo sapiens
  misc_feature 117: n = A,T,C or G
gcattctcctccgcataagcctgcgtcagattaaaacactgaactgacaattaacagcccaatatctacaatcaaccaacaagtcattattaccctcactgtcaacccaacacaggngtgctcat

SEQ ID NO: 36529 - DNA, 241 bp, Homo sapiens
gactaatagcatagccttgagacatagtaggtgctcagtaaatatttgttggatgagtgtttaggtttaagaaagtatctttgcaaacatttgcagcattatcttttaatatttatagctagccagtaatatatgccaatttctgcatctacctatttgtcctctttaactgtatatgccattagcagcaaagcagtaatatggatattactggcaggtttaagtcattgacaggtaagtc

SEQ ID NO: 36530 - DNA, 198 bp, Homo sapiens
atacttttagaagaaataagataaatttaaacctgaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggag

SEQ ID NO: 36531 - DNA, 322 bp, Homo sapiens
gggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 36532 - DNA, 140 bp, Homo sapiens; identical to SEQ ID NO: 33419

SEQ ID NO: 36533 - DNA, 154 bp, Homo sapiens; identical to SEQ ID NO: 30916

SEQ ID NO: 36534 - DNA, 298 bp, Homo sapiens
aagagcccaattctagacttctaggatgtcaggagccatgctcttaagcttctcaccctgctgttttaatgagattaatgattattttccactgagcacctacctgtgatgttcataaaaaagtgaaataaatgactcacatggagatttggaaggatatcactgtggaaagtagatgttaacagcctctagaaatatgataattatcagctatttgagatgcagtcactgtaatgtgataacaagatgtgttgtgcaggtagaaagcatggagagaaatggcacaaagtagagttat

SEQ ID NO: 36535 - DNA, 467 bp, Homo sapiens
caggcagccctggacttgctagcccaaagaaggaggatgtggttaatctgtttcacctggcttgtcctaaggccatagttaaaaagtaccagctctggctggggtccgtgaagcccaggccaggcagccaaatcttgcctgtgctgggcatacaaccctctgcttccacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacct

SEQ ID NO: 36536 - DNA, 123 bp, Homo sapiens
gggcacctgtaatcccagctacttgggaggctaaggcatgagaatcacttgaacctgggaggcggaggttgcagtcagctgagatcgtaccactgcactccagcctggaggagactctttccc

SEQ ID NO: 36537 - DNA, 334 bp, Homo sapiens
caaaataatgtggctgtcaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtgcatatttttcatatagttttgtttaaaaaataattcacgcaaaatcttgaagtcatttttgctattgaaataaaccttaattaaaat

SEQ ID NO: 36538 - DNA, 167 bp, Homo sapiens
atctgtgaactgaattcccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaatc

SEQ ID NO: 36539 - DNA, 159 bp, Homo sapiens
  misc_feature 3, 14: n = A,T,C or G
ganctcttagcggnggatcactcggctcgtgcgtcagatgaagaacgcagctagctgcgagaattaatgtgaattgcaggacacattgatcatcgacacttcgaacgcacttgcggccccgggttcctcccggggctacgcctgtctgagcgtcgcttg

SEQ ID NO: 36540 - DNA, 242 bp, Homo sapiens
cagtgaacagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttc

SEQ ID NO: 36541 - DNA, 233 bp, Homo sapiens
  misc_feature 7, 11: n = A,T,C or G
acacggntgantgctgctaaaaacaaggactggggctgctcccatcattgatgtggtgcgatcgggctactataaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttc

SEQ ID NO: 36542 - DNA, 110 bp, Homo sapiens
cacacaagagttgttgaaagttgacaagcagactgcgcatgtctctgatgctttgtatcattcttgagcaatcgctcggtccgtggacaataaacagtattatcaaagag

SEQ ID NO: 36543 - DNA, 201 bp, Homo sapiens
acacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattg

SEQ ID NO: 36544 - DNA, 116 bp, Homo sapiens
  misc_feature 7, 17, 25, 26, 39, 41: n = A,T,C or G
gggtaanattccaatgnggattttnnctttgtatatatncntatgtctcgtaggaatgtaaaaaccagtatgaccttgtctagtctccaaacttaaaataaacttttgaaaagccg

SEQ ID NO: 36545 - DNA, 238 bp, Homo sapiens
  misc_feature 194: n = A,T,C or G
ggctgaggtgggcggattgcgaggtcagtagtttgagaccagcctgaccaacagggcgaaatgctgtctctgccgaagatacaaaaattagctgggtatggtggtgggcgcctgtaatcccagctgcttgggaggctgaggcaggagaattgcttgaactttggaggtggaggttgcagtgagccggggctgtnccacttgcactccatcctgggtgacagagcaagactctgtcttg

SEQ ID NO: 36546 - DNA, 285 bp, Homo sapiens
gagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 36547 - DNA, 400 bp, Homo sapiens
gggaacgggacttctaaaagaactatgtctggaaggctgtggtccaaggccatttttgctggctataagcggggtctccggaaccaaagggagcacacagctcttcttaaaattgaaggtgtttaccgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttg

SEQ ID NO: 36548 - DNA, 322 bp, Homo sapiens
gatttcaatcttctacccttgggagttctggcgtttggcacaaagtcccctttgcctgtttggagctcagtgctagaccaggtcccctgccccgagctttgtttttggggttatttattgaaacaaagtgtggggagctggttgtgggtgtgagtgggggtgtggggtccaggctgggcccagtgaaaaggaggaaggggttcccatgcgggggaggctctggggctgaggggaacaattctcacgtgtttggtgcttagagacctgcccggggcgttgggcaggccctccgggggctgaattaaaaatgctttatttccat

SEQ ID NO: 36549 - DNA, 500 bp, Homo sapiens
  misc_feature 12, 20, 29, 34: n = A,T,C or G
aaacccagcagnagcagttngccatatangaggntcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgat

SEQ ID NO: 36550 - DNA, 469 bp, Homo sapiens
  misc_feature 17: n = A,T,C or G
agaacagaggcctcagnaaataacgctacacatctacaaccacctgaactttgacaaaccggacaaaaacaagcaatggggaaaggattccctatttaataaatgatgttggggtatcataccaatttatgagatggtcatttggctcttgagtggaggccacctctcagtgactcagcaaaatttgtcctctgcacggtccttgtatcttgtaccacctgaggcaatcaagtatattctgctttatatcatagttatttatgagttaacgcatctccttactgggtcccaaattccttgaaggttgcaacctttgccttgcctattcattttcacatactacgcagcacttagggcagtgctttcaatgtagcaggtaaccaattgttttgcttgcttttaaagtagttgtttttaaattgacttgagcttagttctgcaagaagactagatgagatatgaattttgt

SEQ ID NO: 36551 - DNA, 471 bp, Homo sapiens
gggccccatccctggcaagctgtcctgactgccatttccttcccaagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaggccagctccctgagttcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttat

SEQ ID NO: 36552 - DNA, 270 bp, Homo sapiens
  misc_feature 6: n = A,T,C or G
atagtnctttttattttggcattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaagaaatatcaacggataactgacatcgttttgttaagaagttaactgtatcatagctcactactgccagagcggcaatggatgt

SEQ ID NO: 36553 - DNA, 277 bp, Homo sapiens
  misc_feature 12, 20: n = A,T,C or G
ggaataaccagnacactagnaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctaca

SEQ ID NO: 36554 - DNA, 391 bp, Homo sapiens
ggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttc

SEQ ID NO: 36555 - DNA, 160 bp, Homo sapiens
atcccatggcagaaggtggaagggcaagagatgatgaagagacagagtgtcagagtagccccaagcacagctccagagaaaggaggaggatccaacaataaaatattaatttataaaaaagaaattttaaaaagtaacaagaaagaactcgtttgaaacc

SEQ ID NO: 36556 - DNA, 462 bp, Homo sapiens
  misc_feature 58, 73, 141, 255, 280, 438, 445: n = A,T,C or G
gaaagaaagaaaagagagagagagagagagagagagaggaaggaaggaaggcaggcangcaggcaatgcttcnataaatccattaaaacacattcaaacttcagaaataaacgtgttcaaataagaccagcagtccttggnggtggcttatcatttcacccatttgacagttttaaaagattgactgaactcagtattgattaaggtttaggggaaaggctgtctcatatactgtgtttacaaatgtgaatgagnacagcctttccagagggcagtttgnctatgtgtatcaaaatataaaatgtgtttgttttgacactacaatctcacttctagaattttactctaagaaaagataagtgtgtgaaaagaaatttaagtgtgtgaaaagatgcatatgcgtgggattgctcatcacggtttcatttataatgaggnacagcanacccgttaaatatccct

SEQ ID NO: 36557 - DNA, 282 bp, Homo sapiens
  misc_feature 2, 29, 33: n = A,T,C or G
gnaagccaggttttcaacctagtcacagnatcngcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcaccctccttctgcttgcgcaagtttcctgggctggaccgtttcaacagagaggcttatttgactttatgctagaagatgaggcttctg

SEQ ID NO: 36558 - DNA, 430 bp, Homo sapiens
  misc_feature 430: n = A,T,C or G
cagtcttcaaattttggacccatgaagggaggaaattttggaggcagaagctctggcccctatggcggtggaggccaatattctgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtaaatttttttttttgcn

SEQ ID NO: 36559 - DNA, 490 bp, Homo sapiens
ggggtttgttgttgttgcttatgcagagagattattttctttttattattttataatttttgaaatagagatggggtctcactgtgttgcccaggctggtctcgaactcctggacttaagtgagcctcccgcctcggtctcccaaagcgctgggattacaggcaggagccactgagcccagccaagacttcagtgttgactgctttggaggcacaaacccatgcaggcgttagttccaaagttcagtgtgtacccttaaatgaacaatgaagcaggtaaaattacccttgaaaaaaatcccttggaccacccataaatgacagtgactttttcaatatggactcatcatagccactgcacctggccctgttttcatggcttttatttcctttcatcccacacatttgtctgcagtactagacatgttttacaaatcaacaagtttacacaagtatatgcagcttgttttggggggaaaggagacaaaata

SEQ ID NO: 36560 - DNA, 466 bp, Homo sapiens
tactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagc

SEQ ID NO: 36561 - DNA, 107 bp, Homo sapiens; identical to SEQ ID NO: 31600

SEQ ID NO: 36562 - DNA, 139 bp, Homo sapiens
gggcatggtggcacaaacctgtagtcccagctactcggctgaggcaggagaattacttgaacccaggaggcggaggttacagtaagccaagatcatgccactgcactccagcctgggtgacagagggagactccatcct

SEQ ID NO: 36563 - DNA, 400 bp, Homo sapiens
  misc_feature 249: n = A,T,C or G
tggtgtgattccgtcctgcgcggttgttctctggagcagcgttcttttacctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggngcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttga

SEQ ID NO: 36564 - DNA, 183 bp, Homo sapiens
  misc_feature 3, 26: n = A,T,C or G
tanctttagtaaattaataggaaganccaggcccagtggcacacacctgttatctcagccacttgggaggttgaggtgggagtattgcttgaggcagggagttcgggactgtagtgtataatgattgtgcctgtgaatagccagtgcactctagcctgggcaatatagcgagaccctgtctcc

SEQ ID NO: 36565 - DNA, 115 bp, Homo sapiens
aagtaaaaaaaattaaccggtgcagtagcacatgcctacagtcccagctactcgggaggctgaggcgggaggatggcttgagcccaggagttcaagatatagcagaccttgtctc

SEQ ID NO: 36566 - DNA, 152 bp, Homo sapiens; identical to SEQ ID NO: 33500

SEQ ID NO: 36567 - DNA, 298 bp, Homo sapiens
cacctcccgggttcaagtgattctcctgcctcagcctcccgagtggctggggttacaggtgtatgccaccacacctggctaatttttgtatttttagtagagacggggtttcagcttgttgaccaggctggtctcgaactccttacgtcgtgatccacctgcttcggcctcccaaagtgctgggattacaggcgtgagccactgtgcccagcttcttctagtaagtaattattttcacttggttgatttatatctttttcatctatctgtggcaacatactgcttggaggaattaaca

SEQ ID NO: 36568 - DNA, 216 bp, Homo sapiens
  misc_feature 17, 42: n = A,T,C or G
ggtggcctattaccagnaaatatgtggatgaggcttccaagnaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgaggg

SEQ ID NO: 36569 - DNA, 122 bp, Homo sapiens
aaacgcaggtgtcctaaggacgagctcagggaggacagaaacctcccgtggagcagaagggcaaaagctcgcttgatcttgattttcagtacgaatacagaccgtgaaagcggggcctcacg

SEQ ID NO: 36570 - DNA, 270 bp, Homo sapiens
acatcaccaccatcttcaaagtaagcaccctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaaagc

SEQ ID NO: 36571 - DNA, 454 bp, Homo sapiens
atgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtagccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactca

SEQ ID NO: 36572 - DNA, 483 bp, Homo sapiens
gcttgaattatcacaaatcccaaattaattggttcttattaatgttactttatcaaagacttttcatgcatttcaacatttcagtgtaatggaatcagatttagaaaggtaaggcaagagaatgagaaaggaaaacttgcttttgtcactttgttctctccccagaaagcattgatgatttcattaagcctagcgatcttaagtaacccaagcattcactctggttgccagcagtggcaaccctctgcaaagctggctttgtaataaccctcgaagggtcccatcaggagagagaaagatggcctagccaaattctcccctcatcacgtcctactcccctcccctatacagctgagtcctaagagtccctggatccctcctttctccagtgactataagtatcccataacagagtcctcttcccacattatattgcttaagaattcagtcttgccttcctggaaacacaaatcattttagcat

SEQ ID NO: 36573 - DNA, 242 bp, Homo sapiens
ggttgaattcatagcaccatcattcatttgttatttcacatttatagaccaccaaatatatgagaggcacttggggaacaatgatgatcacgtcctccaggagcccagtgggagatatagttaagaaaacaagtattttacggtacagtggggaagtgttaatagggatgatggtgttctctaggagttgcttgagaatattatcttttctgtttttgaaagcatctctaaaaaatgaaagc

SEQ ID NO: 36574 - DNA, 471 bp, Homo sapiens
atagtatgtgactctacataacatactgaaactattttatacttttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtgggatgtttataaacaagactaagtctgacttcataagggctttctaaaaccatttctgtccaagagaaaatgactttttgctttgatattaaaaattcaatgagtaaaaca

SEQ ID NO: 36575 - DNA, 272 bp, Homo sapiens
cacagtggctcacacctgtaatgccagcaatttgggaggccaaggtgggtggatcacgaggtcaggagttcgagaccagcctggccaacatagtgaaaccccgtctctactaaaaatacaaaaattagccgggcatggtggcgcgcacctgtagtccaagctactcgggaggctgaggcagagaatcgcttgaatccagaagatggaggctgcagcgagccaagattgccccactgcacaccagcctggccgacagtgtgacacttcgtctc

SEQ ID NO: 36576 - DNA, 338 bp, Homo sapiens
atatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcggccagggcttacctgtacactgacttgagaccagttgaataaaagtgcacacctta

SEQ ID NO: 36577 - DNA, 382 bp, Homo sapiens
tatggccggggggcctctctgtgttcatgacttcagtccctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaaga

SEQ ID NO: 36578 - DNA, 311 bp, Homo sapiens
  misc_feature 5, 6, 18: n = A,T,C or G
cacanngcaatttttagnaattaaaaaatacaaccaaaatgaaaaactcaatggattcaatgtcagaatagagaagatagaggaaagcatcagtgaacttgaagatagaacaatagaacttacccaatctgaacaaccaagagaaaacagacttaaaaaaaatagatagaatctgactcctcaacccctttggccatggcaggcaccttttggactgggctgccactgcttgggcagagtaaaaggtgccaggaggagcatgggggtggaagtcctgtcagccaaaaaataaaagtttacctcagagctgc

SEQ ID NO: 36579 - DNA, 486 bp, Homo sapiens
ggtcttctatctcttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtaca

SEQ ID NO: 36580 - DNA, 425 bp, Homo sapiens
  misc_feature 424: n = A,T,C or G
tatggccggggaactgaggtttttctgctatggttctgaaccatttacctgatagactgggttatatattcccagttaaccactactgggttaagtgacctaatgatattagtagccacttaattattttcaagcattctgcctaggacatcgtttcataaaattaaggtttaacaggactgaatcccaacattagtagtataactaaattctctcaggagctttttatgaatgccttagtagtactttggcttcttgaagaggagctaatgccataaccttttttaaatcatccatctgcagctgggcatggtggctcacacctgtaatcccaacactttgggatgctgaggtcggcggatcacagggtcagcagttcaagaccagcctggccagcatagtgaaaccctgtcttcactaaatnc

SEQ ID NO: 36581 - DNA, 219 bp, Homo sapiens
atattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttct

SEQ ID NO: 36582 - DNA, 355 bp, Homo sapiens
  misc_feature 216, 260, 309: n = A,T,C or G
aaaccataggtgaaaagttgtgctgtgtgcaaagtatccaacagattatttatttaaaatggaggaaaattcctttacaactgagatgtggctaatatctcagttgtaaaggtactttaatgggtccgactgacatgctttctaatggggtgcaaaaaaaaaagatggagactgttttagattaaaagaggccaacaaatgaaaaccaaatgggtntataatgcttgaatgagattcctggattttaaaaaatagatgtntatttgtcagtaaactagaaggaactcaaatgctaatcagttgaggatnggttgagtaaaatttgatatagccaaacaacagaattccattcagc

SEQ ID NO: 36583 - DNA, 156 bp, Homo sapiens
atcgctaaccccactaaaacactcaccaagtacctcaacccctgacccccatgcctcaggatactcctcaatagccatcgctgtagtatatccaaagacaaccatcattccccctaaataaattaaaaaaactattaaacccatataacctccccc

SEQ ID NO: 36584 - DNA, 461 bp, Homo sapiens
  misc_feature 18: n = A,T,C or G
cacggaaaggctcccagnaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcgggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggac

SEQ ID NO: 36585 - DNA, 417 bp, Homo sapiens
  misc_feature 15, 17: n = A,T,C or G
ggcagggggactagnanaatggttggggatgaaatcataggggtgttgaaactgtcttcacctgccgagtcagttcctgggtgggggccatgggtcactggtctggttggcatccattgatctaccagattgcaaggtctgaaaaatatctcagacactcaggttttacaataatgatgttatctatgttaaaaacaacgatgatgttatctatattttaaaaagcaaactaagaaacaatgactggttataattcaactatagctacatcttagcagaaaagcaagctaagagataatgactggttatggtttatgcctacagcttgacagaaaggtgtgcggggggtgagacaatcaattcttagtgaccaccttctatcgaactgactatatgcaggcaatcatgcatctacga

SEQ ID NO: 36586 - DNA, 500 bp, Homo sapiens
  misc_feature 2, 18: n = A,T,C or G
cntactggcccagggacnccggctcttatggccggtctcttttctagttattattattataccaataggaatatataggaggtctgagcaacaatatcaacttcctaaaactaattaatgtttcataaaacactaaactgaattgaaaaatacttgtttacttaaagtgcacatggaacattaacctacaaagatattacttatactaggccataaaagcatctccataaatttgaaaatacagaaacaaatatgaggacaaaaaaatcatatagtctgacgtctaaccacactaaaatcaaattagaaatcattaacaatagaatattttaaaatatccccaaatattttagtgttaaactatatgcttctaacccaggagtcaaatatgaaatacaagcgaaatgtaaaaatgtttaaatatcaaaacgtaatgtatcaaaatgtgtgggattgcaattaaagcagcaatttaggggggaatttgtagctttaaaatg

SEQ ID NO: 36587 - DNA, 355 bp, Homo sapiens
ggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaagc

SEQ ID NO: 36588 - DNA, 128 bp, Homo sapiens
tgatggcccggggaatggggtgtttacacagtctgtatacacttgacaaactcattgtaaacttaagatctgtacttcttactgtatgcaaattttaccttaataaaaaatcctctcctttgtcatac

SEQ ID NO: 36589 - DNA, 257 bp, Homo sapiens
  misc_feature 14, 255: n = A,T,C or G
caagagatcaaagnataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataanga

SEQ ID NO: 36590 - DNA, 402 bp, Homo sapiens
gaagaagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattg

SEQ ID NO: 36591 - DNA, 469 bp, Homo sapiens
agggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattagcactgagatccagagaggctggatgacttgctcaagttcaccagcatggtagtggcaaagagaggtccagagtcctggcccttgatgcccagctcagtgccacaaagctcagtaggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaac

SEQ ID NO: 36592 - DNA, 265 bp, Homo sapiens
  misc_feature 12, 34, 210: n = A,T,C or G
ggaaatgccagnacgctggggatgctggtacaanttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagngtaacaaccatataataaatcacctcttccgctgttttagctgaagaattaaaac

SEQ ID NO: 36593 - DNA, 442 bp, Homo sapiens
  misc_feature 14: n = A,T,C or G
gggcaacacaaagnacaaaggctgctctatacaccttatttgcctcttgaggatattgagaaaatatgtgtctactaagctctcaaactttttttactgatgatttaaggaattgctatcatcagcattctcatcagtcttggggccttttttctttcctatcagacttaacaccaagttgagatctcactgttctctcggtgctgaggcagctcctggaagaccctgcaaacctcagcccctgcctcccctccccttccatcactagccagtgataggaacaatatgtatatgcagagacaaggcagcaacattcactactgagactgtcgctgtcaggggaaaaagcagtctatagaagaaacacaaaacagcccagaaactaacagctgcctggtgtgtgctattatgctgcaaaatgttccagctctgatgacattgc

SEQ ID NO: 36594 - DNA, 467 bp, Homo sapiens
ggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacag

SEQ ID NO: 36595 - DNA, 347 bp, Homo sapiens
ggaaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcaggaac

SEQ ID NO: 36596 - DNA, 330 bp, Homo sapiens
atgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacac

SEQ ID NO: 36597 - DNA, 400 bp, Homo sapiens
ggggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggacc

SEQ ID NO: 36598 - DNA, 373 bp, Homo sapiens
gtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgctcacctccaagcatttcatgaaaaagctgcttcttattaatcatacaaactctcaccatgatgtgaagagtttcacaaatccttcaaaataaaaagtaatga

SEQ ID NO: 36599 - DNA, 398 bp, Homo sapiens
gtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcacttttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttg

SEQ ID NO: 36600 - DNA, 173 bp, Homo sapiens
  misc_feature 8: n = A,T,C or G
tgccaagnagtgcaaatgcacctcctgcaagtaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatat

SEQ ID NO: 36601 - DNA, 468 bp, Homo sapiens
  misc_feature 210, 211: n = A,T,C or G
atggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgnnttccctgtgtattttggctatcacaaaactagggttcttctgtttttaacttatgcatttaatgacacattgccatcttttagaattttttactattcaacagaataagctgatgtttggtggcagaggagttattagttgccgtgaactgtcaagagattgcagtgcaggagggcaacagaaactgtacaaggtgcagacttgagtcatgtaagatctatgtgaatgaaccaaagtaactagagtcagtcaagcac

SEQ ID NO: 36602 - DNA, 470 bp, Homo sapiens
tcagttagccgcaataaatcaattaaggacattatatgtaacttttaggtaaaagtcaattctccagactcatatctagattaaactggcatatattcatccaggtgggatccataaaggtagtattagaccaccgctctcaatgaaaactaggaaaacctgtttgaaggcagcaggaagctgctcgggcaacaataagtgcagacaccaacctttcagaaaagagagaatcttgtacaaataagctgcttcaacaactttttcccaggggacacttgctgatgttaagtatgggcaggaaacgggattcaagcattaggcccagaaatactgttgccgaaagtcaaaaaacagcacagaggttttggtggagtcctacctagatgcatcaagcatgaggagattctcccctcagttcagttgtttaatcctggggctacctgggatgagaaacttaaaacctaagtaga

SEQ ID NO: 36603 - DNA, 445 bp, Homo sapiens
  misc_feature 3: n = A,T,C or G
tanggccggggaattaagcagatagcaattggcttttccctttaatgctcctatagcacatctaagagcataattgagcttaatgcttaacatatattaaacatttcttaagaatgagacaatgcattatctcatttaatcatcattattatccccattttaggaaattgagatttggagaagtataccaacttgaccaggttcacacagcaagtagatggcagacatagggattgaatgactccaaagtctgtgctcttatgcactatactaaattgtctttaatgcatcatctactacgttgcatgtaattatttatttgtagaatgtcttctgactcaactacaagatcctgcctataataccaaatgtctgacacattaaatgaataattggattaatgataatccaaagtagaattgaggtatttctgtaatctctattg

SEQ ID NO: 36604 - DNA, 334 bp, Homo sapiens
  misc_feature 256, 262, 284, 299, 302, 325: n = A,T,C or G
caaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttnttaaanaattttcaaaatcaaattccanaatgattttacgganatntcccaggaaaattaaggcttctnttaaacact

SEQ ID NO: 36605 - DNA, 437 bp, Homo sapiens
  misc_feature 421: n = A,T,C or G
gttgcccaacctggagtgcaatggtgcaatctcagctcactgcaacctctgcctcccaggttcaggtgattcccctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtntataacagaatcaaga

SEQ ID NO: 36606 - DNA, 179 bp, Homo sapiens
  misc_feature 167, 178: n = A,T,C or G
agaaggaagacaacctgattttttggtgtgtattctatcataaaacatgaaaactacaatattttaatggatagcacattttctaagtaatttaaaccttaattaaccaaaacccaactaattttaaacttaagtaaccatgtttttatattctcaattttcacganaaaaaaggggng

SEQ ID NO: 36607 - DNA, 194 bp, Homo sapiens
gaggccgggggcagccccaagcctaattgtcacacagcaagtaagcactgctcttaggatgactgggaacctccctttcaaagttccccatcctcctaccctttagaaaactttggagatacagcaaggcaaaacggaacaatgttagccttttgatttgcctctggggacagctcttgccagggcaaattttg

SEQ ID NO: 36608 - DNA, 229 bp, Homo sapiens
  misc_feature 227: n = A,T,C or G
atggccagggaggcattgaggcagccagcgcaggggcttctgctgagggggcaggcggagcttgaggaaaccgcagataagtttttttctctttgaaagatagagattaatacaactacttaaaaaatatagtcaataggttactaaaatattgcttagcgttaagtttttaacgtaattttaatagcttaagattttaagagaaaatatgaagacttagaagagtngc

SEQ ID NO: 36609 - DNA, 468 bp, Homo sapiens
  misc_feature 453: n = A,T,C or G
aatctaggaatcgatacactcaggaggcatttttttcttcaagattctctttactgttattttcctcaatgacatgccatttagattgccagataatctagaagtttgctagtatccctcgtgattgatcatttattctgcctgtgtattccatggtgttctttgtgcatataatttttaattaagacataataattgtacatatttatggggtacagagtgatatttcaatatcggtatacaatatgtaatgatcaaatcagggtaattagcatatccatcacctcaaatatttatcatttttgttttgagaacattcaaaatcatgctgtcttctagctacttgaaaatactcagtaaattgttaactatagtcaccttcaatgctgtagaaaactagattctcctatgtagtattctatagaaattcctcctatctagctgtaattttgnatcttttaaccaact

SEQ ID NO: 36610 - DNA, 434 bp, Homo sapiens
gatcctagtacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtg

SEQ ID NO: 36611 - DNA, 292 bp, Homo sapiens
acgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgcataacccatatctgtgcaatggaatataaatatcacaaagttgttta

SEQ ID NO: 36612 - DNA, 223 bp, Homo sapiens
  misc_feature 3, 14, 32, 48, 83, 99, 111, 126, 127, 203, 213: n = A,T,C or G
agnaaatgaaaccnggcgcaatagtatatagnaccgcaagggaaagangaaaaattataaccaagcataatatagcaagggcnaacccctataccttcngcataatgaatnaactagaaataactnngcaaggagagccaaagctaagacccccgaaaccagacgagctacctaagaacagctaaaagagcacacccggcganggagcaaaanagggggaaga

SEQ ID NO: 36613 - DNA, 293 bp, Homo sapiens
  misc_feature 5, 14, 41, 48, 51, 105, 122, 129, 139, 155, 216, 252, 268: n = A,T,C or G
aaaangtctactgntcacgaaatcctgtgcaagctcagctnggagggngancactctacacccccaagtgcatatgggtctgtcaaagcctatactaactttgangctgagcgggatgcttngaacatngaaacagccntcaagaccaaaggtgngggtgaggtcaccattgtcaacattttgaccaaccgcagcaatgcacagagacaggatatngccttcgcctaccagagaaggaccaaaaaggaactngcatcagcactgaagncagccttatctggccacctggagac

SEQ ID NO: 36614 - DNA, 101 bp, Homo sapiens
cgcaggcactgtgtgtgtcctacacaatggtgctattctgtgtcaaacacctctgtattttttaaaacatcaattgatattaaaaatgaaaagattattgg

SEQ ID NO: 36615 - DNA, 491 bp, Homo sapiens
  misc_feature 12: n = A,T,C or G
gaaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagc

SEQ ID NO: 36616 - DNA, 360 bp, Homo sapiens
  misc_feature 1, 2, 9, 20, 359: n = A,T,C or G
nncatcagnaattaatattncctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgnc

SEQ ID NO: 36617 - DNA, 466 bp, Homo sapiens
ggtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttat

SEQ ID NO: 36618 - DNA, 458 bp, Homo sapiens
gggaaaagtacccaggttcacacttacaagtaaccctttgaaagatatgtttgaagatttagtctcagatttgcctgtagtgacaagattaaagactgtcatacaaaaagcactatttttcacttattctgaagcatttcaattgatttaccagacaagtcatccttctttgtctgaagtgacataacctcacttgacaagctgttaagacaaccagggacaaattgatcattgatctaataatcgattagctactgatggatctcttgagtgttgacccatttcttattttcctgttttctttcatggcaccgtatgcaaaatgatcacagtatgtgatcccagattgggtcctggtccagaggaaggacattagtgagaaaatggatcatattctataacgtccgtggattaagttaagagtgttgaagttaagagtgcgcagtggctctgtaaga

SEQ ID NO: 36619 - DNA, 469 bp, Homo sapiens
  misc_feature 18: n = A,T,C or G
gagttccgtcctgacagnagttcacagcacatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaac

SEQ ID NO: 36620 - DNA, 350 bp, Homo sapiens
gatgaaaggaaatggaggagggagaggtgatgaaggaaacagggaggagggagaggtgatgatggaaatggaggaaggagaggtgatgatggaaacagggaggagggagaggtgatgaaggaaatggaggagggagaggtgatgaaggaaacagggaggagggagaggtgatgaaggaaatggaggagggagaggtgatgatggaaacagggaggagggagaggtgatgatggaaacagggaggagggagaggtgatgaaggaaatggaggagggagaggtgatgaaggaaacagggaggagggagaggtgatgaaggaaatggagggagggagaggtgatgatggaaac

SEQ ID NO: 36621 - DNA, 472 bp, Homo sapiens
cagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggag

SEQ ID NO: 36622 - DNA, 183 bp, Homo sapiens
cagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaatttt

SEQ ID NO: 36623 - DNA, 298 bp, Homo sapiens
atcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcggccccagctaaggttgaagccaaggaagagtcggaggagtcggacgaggatatgggatttggtctctttgactaatcaccaaaaagcaaccaacttagccagttttatttgcaaaacaaggaaataaaggcttacttct

SEQ ID NO: 36624 - DNA, 312 bp, Homo sapiens
agaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactg

SEQ ID NO: 36625 - DNA, 471 bp, Homo sapiens
cgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctgatagagagccggattcaccgtttggctcgatattataagaccaagcgagtcctccctcccaattggaaatatgaatcatctacagcctctgccctggtc

SEQ ID NO: 36626 - DNA, 462 bp, Homo sapiens
atttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatcc

SEQ ID NO: 36627 - DNA, 488 bp, Homo sapiens
atgatggattatgcccattaacaggacatactcccaatgtccagtagctttgataccacttcacttcatcccatttgtgaatgagaatcagaatcaggtgaatgagagtgataaggaggggaaaaagcaaggtaaagccactgatgtcataggttgatgccgcttgaggcctgaccagcacaaaagggctgtgggttggtggctggtagaaccactgagtctgggtacaggatgctccaacggtaagtcaggctaatgcagcaacttctctgtgggcagcagctgcagggtggacaggtgagaaaaccccctctacggactgggccgtgtccctggcaaattcatatgttgaagccccaaccctccatgtgactgtattggaaatagagtctttaaggaggtaattaaggttaagtgacgtcataaggatgaagccctaatctgataggactttcgccttataagaagaggaagaaatctctcactct

SEQ ID NO: 36628 - DNA, 475 bp, Homo sapiens
aaagtctctctgctctagctctcaagctttgggtgaatgtccctgcgaaatgtatcttcaagttgaaagttcacactccagtcaaaaactccttttactgagtttgcagtactgtatttgcatgtgtgtatttctctggacctttattgctacttttgctttcctttgttacacagactttgtgttgcactttcttctccagaggggtgatatagagccctggttatatgaataataccagtgatagtgtccacagctcaaatgcaagcccatttgtcatcactcctttcatctctctgagaggatttattgtgtgcagagtatgaagcagttgtggagctctgtgcctttgtcaagataccatcttgtttgatgacttctttctttgttgtttttccttgaaaatgtcagtaagctctgttatgcttctagcaaattgtgagactgtttgtttccaccctcataacctgttgca

SEQ ID NO: 36629 - DNA, 500 bp, Homo sapiens
  misc_feature 5, 17: n = A,T,C or G
tcccngggaattcggcnttatggccgagggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctat

SEQ ID NO: 36630 - DNA, 476 bp, Homo sapiens
tacatacaaagttcttcttaaagcttacttgtaatagtgaaagattagaaacaacataaatgttaatacttaccaacagagtactgatgaaataaattacgataatccacataaaaatacaatggagccattacaaaagaataaataaggtcttcctgtagtaaacagcgtgacctcaagatatatcattaagtttaaagtttaaaaaggcaaggtttagggccgggcgtggtgactcacgcctgtaatcccagcagtttggaaggctgaggtgggtggatcatgagttcaggagatcgagactaacctggccaacatgatgaaacactgtctctactaaaatacaaaaaattagctgggcatggtggtgcgcaccttgtagacccagctactaaggatgctgaggtgggggaatcacttgaactggggaggtggaggttgcagtgagctgagatcgtaccactgtattccagcct

SEQ ID NO: 36631 - DNA, 321 bp, Homo sapiens
agcttaatgggggaaaaatgtggtgaggtggtgaggccgggcatggtggctcacgcctgtagtctcagcacttgggaggctgaggcagaaggatcccttgagcccaggagtttgagaccagcctgggcaacatggtgaaacctcgtctctataaaaaatataaaaaaaattagctggtcttggtggtgtgagcctgtagtcccagctactcaggaggctaaggtgggaggagcacctgggcctggaaagttgaggctgcagtgagctgagatcatgccactgcactccagcctgggtgacagagcaaggctctgtctcaaa

SEQ ID NO: 36632 - DNA, 467 bp, Homo sapiens
agacacagtggagccgcgctcttctccagtgacacgtggacaaatgcgggctcatcagcccccccagaagagggtcaggccgaaccccagttctcctcctcttaggtcattttcagcaaacttgaatatctagacctctcttccaatgaaaccctccagtctattatagtcacatagataatggtgccacgtgttttctgatttggtgagctcagacttggtgcttccctctccacaacccccaccccttgtttttcaagatactattattatattttcacaggcttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcacca

SEQ ID NO: 36633 - DNA, 482 bp, Homo sapiens
  misc_feature 12: n = A,T,C or G
agtgaaagggcnttccaaggaagaggagtagtaggtacaaggcctagaggcatgaaaagattgtggtaagtttgggaatcaggagaaattcagtgtagctagagtgtgggaaaataagagaaaacaatggcataggggtttggagcaatactgtgaagggtttggaagaggctactgagttgtgattttatcctggagatgggtaaatactggagctttcatctaggacattaatgtaaacacattttgtttttggttttattttttagaaatgtatttttggtagtgaaatggaagatgggcccggaagagaaaatctggactcccagagttcaggttaggagaccaagataacctagataagagatgatgaggacttaaactgatgttgaccaggtagacggaggggaaaggatggattatggaacacagttgacatttgagagatactttgtgtgcaaggcacacagcaaaggttactg

SEQ ID NO: 36634 - DNA, 483 bp, Homo sapiens
tatggccgggggagatagggtcttaactctgttgcccaggctggaggagtacagtggtacagttatggctcactgcagccttgacccctctgcctcagcctcccaaatagctggggccacaggtgtgtaccaccactctcagctaatttttaaaattttttatggagacagcgtttcgctatgttgcccagactgttcttaaactcctgggctcaagtgatcctcctgccttggcctcccaagctggtgaaattacaggcatgagccaccacacccagcctgaaattcttaaaggatgagaatgtcaatgacagagcaccttggcatcattgtgactaacctgggagacagggaagaagcacgccatgggaagtgtttacatttgggtacagctgtgctaagtactgtggagcccatagccttgaggtagacggctactttgccttttttcttgaactgtcttgcagaatgtggatttggggt

SEQ ID NO: 36635 - DNA, 477 bp, Homo sapiens
gggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttcctt

SEQ ID NO: 36636 - DNA, 419 bp, Homo sapiens
  misc_feature 2, 9, 27, 43: n = A,T,C or G
anctcggcnattttggccgggaagganattgtgccggaagaanctggcagacagagggaagtccttccagcagggtcagatttcctccttgttctcttgggggatggtgatgcgcatagtttcccctgggattttttgatttcagagttaggacacagaaactgattttcatcaacccatctattatgtactataacagtgtctgctttttgttaaagtctttttcatctatactaaacatgtgtcaatatcagatgctctggagaagtttcaccatatgtggatgcctctaacataggttaggtcattgtaataagcatgactagactttgaaaagtagaatcaaggtacatagcaagcaaaattctcagccactctgattgactctgtaaaaggtaataaaacaaaaactattcagc

SEQ ID NO: 36637 - DNA, 302 bp, Homo sapiens
  misc_feature 301: n = A,T,C or G
tggatgtcccacattcatactctgtgctggagcggtttgtagaagaatgttttcaggctggaataatttccaaacaactcagagatctttgtccttcaaggtactttatttaaatactactttctcaatgtaaaatagtggatgagatctttgggaaggttaactgctaagttagtttatcgttccctgaagtcactgaagaacgtgactcttgtgagttcatggagaaagaagggcgaagcttgttttagcccccttgtaaatctgtacaggactgcctcatgaagtcctagtttatttng

SEQ ID NO: 36638 - DNA, 338 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggc

SEQ ID NO: 36639 - DNA, 411 bp, Homo sapiens
gtctcttagagggtgggcttttgttgatgagggaggggaaactttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 36640 - DNA, 467 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggagggaagaagaggagacttcaaatgaaggagaaaacaatgaagaatcgaatgaagatgaagactctgaggctgagaataccacactttctgctacaacactgggctatggagaggacgccacgcctggcacagggta

SEQ ID NO: 36641 - DNA, 470 bp, Homo sapiens
gggccaaacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtcccgtgaagcccaggccaggcagccaaatcttgcctgtgctgggcatacaaccctctgctttcacatctctgagctatatcctcattagtgaaaggtggctttttgctttataagtttgggctggggagcactttaattcttcccatttcaaaaggt

SEQ ID NO: 36642 - DNA, 187 bp, Homo sapiens
atactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgc

SEQ ID NO: 36643 - DNA, 487 bp, Homo sapiens
agaaaaagtgaaatcaaggctaacagccagcttccccatcaccttgggatccctgaaaggaagtctattccagtatcaatctacaggaagcattgcaagtgcctaaagggagaaatatctccgaagacagccagagacaaggtggggtgataagactatcatcctcaaccctggaaactctgataggtaacttggccaaagttgacaccaaatcagaatggctgttcagcggcactatactataggaggtatgttctgcaggttcctagggcacaaactcctaaccagcattcccacactattgggacattccctttggaacccctcccacttaagatgagcagccctccgactgtttactagagttgaggccaacctgggcttaaggtgccacctagtgctaaaaaggaggcagcaacccagcaggaaaaaaaaagatgagaaagcaaaccagcagctaattataaaaacatctaaggaaacatgt

SEQ ID NO: 36644 - DNA, 272 bp, Homo sapiens
  misc_feature 7, 8, 32: n = A,T,C or G
ctcggcnnttattggccgggaccaagaagagntgaattaattctcagtggcctgagtaaagatctagaggcaaccactcacctattttaaaataataataataattctcttggaattcttccaggtctgttttattaacttcctactttctatactaaaagaagaaaatagattagtaatattgttaacctgatgatgatagaagacttactctttttaaacaaattttcaccctttctaacagtttagctgaacatcctgaagcaagcgag

SEQ ID NO: 36645 - DNA, 476 bp, Homo sapiens
gatctatcctttacggcagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagtagactaagaaagttatagaatcaggaggaaataacagaagaacattctgtttctgaaaatcaagagtcctcctcctcctcctcctcttcctcttcttcttcaacaatttggaaaatcaagtctt

SEQ ID NO: 36646 - DNA, 464 bp, Homo sapiens
  misc_feature 17, 441, 442: n = A,T,C or G
aggttaaggcagatttntttttctgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgnngggtcttattgaaacagtatta

SEQ ID NO: 36647 - DNA, 125 bp, Homo sapiens
catcctgtctggttgcaatgttttgctcccagtaagagaatcagatcatcatgtggggattaccattgttcctggagtactcctacccttagttgaatttccttattaaagttatatttttctat

SEQ ID NO: 36648 - DNA, 472 bp, Homo sapiens
agacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtccggatctcacaggctgagaactcgttcacctccaagcatttcatgaaaaagctgcttcttattaatcat

SEQ ID NO: 36649 - DNA, 468 bp, Homo sapiens
agtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgc

SEQ ID NO: 36650 - DNA, 438 bp, Homo sapiens
cagtcactacaaattaagtgtgtcatgttggaaaattagttcaccatatgtagaagaggaaaactggatctcttacttaatatcatatacaaaagtgatattatatggattaaaaacacaaatgtgaaagaaaaaataaagttatcagaagaatgataaagttaatagaagatctaaaaaatttaaagttaatagaatacgttgaagtttatctttatgacttagatatgaggaataatttcacacaaaaaacattaaaagcacaaacaatgtgggaaaagataaatattactccattatatttttagaagatttctatccaatgaagggctctatggagaaaataaataaataaaataaataatagaaggtattcgcaacatctgaaattggcacgggattaacattgaaaagatacaaaaactgctacgaatcaac

SEQ ID NO: 36651 - DNA, 162 bp, Homo sapiens
ggaattttaccaaacatttaaagaatacctaataccaatcctactcaaaaaaatgttataaaatagaggaagggggaatagttccaaacttattctacaaggccagtattattaaaaagtaattgaggtttttgccattaaaagtcaggataataccctgat

SEQ ID NO: 36652 - DNA, 352 bp, Homo sapiens
gagatcttctggatgtgaacaacagatccaggccagaaggtggcatcatgtctgggtggaggtacctcatctgtgtcagctttttgctgaccattcttcttgaactgacataccagggaccccctgtccccgcttcatcaagcacaaagttgttaatgacaagctattctatgcgctccacggtggtgtctcgctatgcccacaccttggtcacctctgtcctgtttaatccacatgctgaagcccatgaagccatctttgacctggatctgcctcatcttgcctttatctccaatttcactatgaccatcaacaataaagtctacattgcagaagtcaaagagaagcacca

SEQ ID NO: 36653 - DNA, 465 bp, Homo sapiens
agagttgtttgttctttttagttggtcactttacacacttaattttcaattttatttagaaaaagaagttatgcttatgaagcataaaagctgtaattccaaaagttgaattggttttgagaccccaaagtcatgactatgtagagaatttctaaattcttaaggataacctatttaggaaaacctaagaaatcaactattacaactaatgcttcattatgatacctggttacaaaatataaaaaatatccataatcggataataatcgtaaagagggaaaagagctcttttacaacaggggaaaaacaaagcaaaacaagcaagaataagaacaataaaacctggaaacaaacttgtttgtttatatagggcttctatcaatttagttgtaaaactttagttaatatgaaatcaggcttgaataaattgagacatatttatattattgggatgatgtcactgtt

SEQ ID NO: 36654 - DNA, 242 bp, Homo sapiens
  misc_feature 8, 72: n = A,T,C or G
tattattnaggtgagttatgtaatcaaactaggagcaattttaagaatcattttctctgaattttattatcngtaccagtctttgttttgttgcagtctattccattttcaaaaagcctaaataggccaggtgtggagtctcacgcctccaatcccagcactttgggaggctgaggcgggagggttgcttgagtcaaggagttcgagaccactttggtcaacacgggaagaccccatctctc

SEQ ID NO: 36655 - DNA, 467 bp, Homo sapiens
ggggacccaactgattgtcaaaggcggcagattgtagtttttgttttggccggaaaggcttaccatgagttgccagggctgagagagatggagaaggattcgcggcggtgacagattaaattccccagttacattatagacttggagacttgtccttgtgtggacgggagccggaaagccttgagaacttattcctcgacccggacatggcgcaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccaccagccgccttcatcaaatcaaacaggaacctccaaacttg

SEQ ID NO: 36656 - DNA, 263 bp, Homo sapiens
  misc_feature 4, 19: n = A,T,C or G
taantcggcatttatggcnaggctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaacc

SEQ ID NO: 36657 - DNA, 464 bp, Homo sapiens
  misc_feature 461: n = A,T,C or G
cacacccggcctgggactcttcttgcagtgagccagggccatgggacccttcaaaagttgctccaccctaatccccaaaatatctttttctcccgcctgtcccaagtgcctggcatcatactatatgggtcaactggccgtgttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggcttggccaggtgtnggt

SEQ ID NO: 36658 - DNA, 365 bp, Homo sapiens
aggaaatgggctttgccacttttagctccaggcttttctaaccgacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttattt

SEQ ID NO: 36659 - DNA, 468 bp, Homo sapiens
gatcatcatctcataactgagcaagaagactatgcaaatcttagggcgctcgctccctgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatattttattttaaaacaacaaaaagggagggcgttgacaccattccccacagagatagtcatgctgagtgtgggttgtttaaacatgcatattgaaataacacatatagtaacgtgggaatactaaaaaataaccaagattttatatttttgtaaattatactttctatactgtagattgtgtatgttatgtgtttttatggaaagctaataaattaaaggtacagtggtat

SEQ ID NO: 36660 - DNA, 467 bp, Homo sapiens
cacccaaagtcctccaattgactttgaaaggaaaatgaaatatgacaagcatacacatctacctcttgaattaaaggaacagctgaaaacctcaatagcttctagaatgtgtcatgtcttgaatatgctttccgtttagcatctacaggtctacattgacctctcttgttctctgagaacagatcttcttgataggggcctggaacctatcttagttctttagaagtttaaccatcagggaaagactaactgctccatacagtctattttggaatgagcatggactcattattatacaaagacaagatagaacttatggtttaactgaagtttaattaggaaatttgattggctataattcatatgtttctctcactctttttcattgctccattactctctctgtcttgcagacatttttatccggagaattaaagtgggagggagggtagagtcactactctgac

SEQ ID NO: 36661 - DNA, 160 bp, Homo sapiens; identical to SEQ ID NO: 27886

SEQ ID NO: 36662 - DNA, 167 bp, Homo sapiens
ggaaatatggcctcaatatgtgccgccagtgtttccgtcagtacgcggaggatatcggtttcattaagttggactaaatgctcttccttcagaggattatccggggcatctactcaatgaaaaaccatgataattctttgtatataaaataaacatttgaaaaaacc

SEQ ID NO: 36663 - DNA, 151 bp, Homo sapiens
  misc_feature 22: n = A,T,C or G
gttcctccacctcttttgaganggatgtatgctgtcagactttaccaatgggatacacagttggggttttggaaataattttgaatctccttgcagggtagcctgctaaaagacagggttgtagaaccacttccgagggccttctaaactt

SEQ ID NO: 36664 - DNA, 472 bp, Homo sapiens
  misc_feature 432, 442: n = A,T,C or G
atcctcattagtgaaggtggcttttgctttatagtttggctggggagcacttaattcttcccatttcaaaaggtaatgttgcctggggcttaacccacctgccctttgggcaaggttgggacaaagccgtctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagntgaagtgggnggctaacctgaccaataaagttattttatt

SEQ ID NO: 36665 - DNA, 468 bp, Homo sapiens
cactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcatt

SEQ ID NO: 36666 - DNA, 340 bp, Homo sapiens
aacgagaaactggactttttaaaccctcttcagagcaagcgtggaggatgatggagaatcgtgtgatcagtgtgctaaatccctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttac

SEQ ID NO: 36667 - DNA, 197 bp, Homo sapiens
ctagcttgttaataatatcttgataacaaaaagacctcttaaagtgtttaaagtccacaataaggccaggcatggtggcaggcacctgtggagctactcaggaggctgaagtgggacaattgctcgagcccaggagtttgaggctgcagtgagctatgttcgcaccactgcactcgagcctgggcaagagcgagtga

SEQ ID NO: 36668 - DNA, 464 bp, Homo sapiens
tatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttata

SEQ ID NO: 36669 - DNA, 114 bp, Homo sapiens
  misc_feature 3, 16: n = A,T,C or G
acngggtatttcggcnttatggcgggggtttgtggtccccccccaccacaaacacagcacttcggctcctctaacctgtgccacaggtgaccaccaataaaatcctctgctgag

SEQ ID NO: 36670 - DNA, 218 bp, Homo sapiens
  misc_feature 218: n = A,T,C or G
gaggcattgaggcagccagcgcaggggcttctgctgagggggcaggcggagcttgaggaaaccgcagataagtttttttctctttgaaagatggagattaatacaactacttaaaaaatatagtcaataggttactaagatattgcttagcgttaagtttttaacgtaattttaatagcttaagattttaagagaaaatatgaagacttagaagagtn

SEQ ID NO: 36671 - DNA, 202 bp, Homo sapiens
  misc_feature 5: n = A,T,C or G
gagancaacctggccaacatggtgaaaccccgtctctgctaaaaatacaaaaattagctgggtgtggtggtgtgtgcctgtaatcccagctagttgggaggctgaggcaggagaatcccttgaacccaggaggcagagattgcagtgagccaagatcacaccactgcactccagcctgggcaacaaagggagactctatccc

SEQ ID NO: 36672 - DNA, 472 bp, Homo sapiens
ggcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaacttcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaagt

SEQ ID NO: 36673 - DNA, 156 bp, Homo sapiens
  misc_feature 19: n = A,T,C or G
ggatccccttctgtttttnagacaagttaacacataagtggctccttcagttccatttcaacagacagttgctttcctggcctgtcttctccaggccctggaatcgaatatacatatggttttgtggttggggcttttttgaaagacagattcccc

SEQ ID NO: 36674 - DNA, 290 bp, Homo sapiens
agggagagctgtgctcacagttttgttaatttgcagtggtagcattctttatcactggctgaaactcaagtaaaggagtgaaagatcaagtatttgttgagaaactattttgtgcctagcatcatgctaaggattatggtgacaaccgcaaaaggttagtttcatggcacttgttggagatgcatgtatttaacttgcaaatagtatacacaactcgtgtgttattaagttatgaaatattgaaaaagcataacatgggagtttaataatggaacacagacagactgaat

SEQ ID NO: 36675 - DNA, 276 bp, Homo sapiens
cactgtggcttacacctgtaatcccagcactttgggaggccgaagcaggcggatcacgaggtcagaagttcgagaccagtctggccaacatagtgaaaccctgtctctactaaaaaaatacaaaaaaaggccgggcgtggtggcgggagcctgtaattccagctactcgggaggctgagacaggagaatggcgtgaacgccggaggtggagcttacagtgagccaagatcgcactattgcactccagcctaggcgacagtgcaagactccgtctca

SEQ ID NO: 36676 - DNA, 103 bp, Homo sapiens
gttaactgagctactagaagatattcttatttcactaaatgtaaaatttggagtaaatatatatgtcaatatttagtaaagcttttcttttttaatttccagg

SEQ ID NO: 36677 - DNA, 294 bp, Homo sapiens
aaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctgttccccaataacctatggaaatgaaaatacaaaaaataaaaggaaaactcaag

SEQ ID NO: 36678 - DNA, 476 bp, Homo sapiens
  misc_feature 21, 430, 445: n = A,T,C or G
atgagttcctggcggcccagnaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgactgtgtcaccccctgcattgtgctgccatttggccagcctgtccaagggcatgacaccaagtagacactacagagagagaaacactacagcaacccaggggttgtcctgaaacagacttttatacttgaacatggagactgcacatggctttanggggtttgtgcttgngggataaaccggaagctacagtgagaacata

SEQ ID NO: 36679 - DNA, 139 bp, Homo sapiens
ctcttaaaatatgtcagggcgctaggcacagtggctcatgcctgtagtcccagctcttgggaaggcagaggcgggaggacgacttgggcccaggagtttgagacctgcttggggaatgtagtgagaccttgttctccac

SEQ ID NO: 36680 - DNA, 468 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggt

SEQ ID NO: 36681 - DNA, 356 bp, Homo sapiens
catttctttggacttaaagtgatgactccctgtatgtcccatacatacttgtcatcaggattttcagatttgaagaaagttgtctttttagaaaatgattatcgttaggcaaactgtcaaagtagactgtttgggggactaaatttaaagaaggaaaagagagggagagagacagagggacactgtgattcatgggaatgcctgtcccagttgattcctattcttaaattgaactctgtttacatagctcttaatttggtacccagataccttcagtttattttcagcccaaagacttccatctacagccctcctggtagttaatttctaaaattctggtttatttatcatcctca

SEQ ID NO: 36682 - DNA, 349 bp, Homo sapiens
catgagctaaaggatcatgctttcctgtcccggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacattt

SEQ ID NO: 36683 - DNA, 406 bp, Homo sapiens
  misc_feature 25: n = A,T,C or G
ctgagaatacagatcaacccacagnaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaacccttttgccttccaaattaaagaactccatgccactcctccat

SEQ ID NO: 36684 - DNA, 117 bp, Homo sapiens
  misc_feature 33, 117: n = A,T,C or G
ggggaaagcaaaggattttaatgttacggagtntgaaaaatttattatgtaattcagatgctaccttgcaactaaacttaagaaatgattatttgttgagtttaggtgtaatagccn

SEQ ID NO: 36685 - DNA, 141 bp, Homo sapiens
  misc_feature 1, 17: n = A,T,C or G
ncagacttttattaagnagttattaaggtgtataccttcaaccaaaaggaaatgaacccagggagaagttataggatctaagaaaactagtgactcataatttaataaatatataaacaaacacaatcaagtacagattgg

SEQ ID NO: 36686 - DNA, 272 bp, Homo sapiens
  misc_feature 239: n = A,T,C or G
ataatttaaaaattagccgggggccaggtgcggtggttcacacctgtaatcctagtgcttttcaggagttcgagatcagcccggccaacatggtgaaaccccatctctgctgaaaatacaaaaattagccgggcgcggcaccatgtgcctgtaatcccagttacctgtgaggctgagggaagagaatcactggaacctgggaggcagaggctacagtgagccgagatcgtgccactgcnctccagcctgggtgagagagcgagactctgtct

SEQ ID NO: 36687 - DNA, 468 bp, Homo sapiens
  misc_feature 26: n = A,T,C or G
gggccatggttaaatgacatccaagnaatgttttgggtccttggttaaaaacactccagttttgttttttgaagaagaggatggcagtagtagccctggaaaacctgaagaagtcactgagcaagccatgatgttgtgaagtagcataacggattttaattagagttgttaatttacagggcacccaggatgtcaatacagatgacttaagggagcaaagatggttctggcaccaccaagaacctttctcctgaagtaactagccaacctggaaaaagtctccctcagttggaagaaagctatttgagaaaataacattttggaacaaagcctgtttttcatactcactctataagaacatatattaaaaatagatgttcaaaaacaattttatttaaataattaacatacaatgagaggtgtacctgttataatttaaaatattattattaaaaagaatcatttctc

SEQ ID NO: 36688 - DNA, 246 bp, Homo sapiens
  misc_feature 179, 220, 221: n = A,T,C or G
gaggccttgaggccgccagcgcaggggcttctgctgagggggcaggcggagcttgaggaaaccgcagataagttttttttctctttgaaagatagagattaatacaactacttaaaaaatatagtcaataggttactaagatattgcttagcgttaagtttttaacgtaattttaatancttaagattttaagagaaaatatgaagacttaggaagagtnncatgaggaaggaaaagataaaaggt

SEQ ID NO: 36689 - DNA, 466 bp, Homo sapiens
aggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagac

SEQ ID NO: 36690 - DNA, 480 bp, Homo sapiens
agtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcat

SEQ ID NO: 36691 - DNA, 453 bp, Homo sapiens
  misc_feature 399: n = A,T,C or G
agatagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagnagagaagtatccaattatgtgacaacctttgtgtaataaaaatttgtttaaagc

SEQ ID NO: 36692 - DNA, 444 bp, Homo sapiens
attctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcg

SEQ ID NO: 36693 - DNA, 465 bp, Homo sapiens
gaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagt

SEQ ID NO: 36694 - DNA, 275 bp, Homo sapiens
tatggccgggcgtgtggtgtattttttaaaaaatttgatttagcattcctattttccctcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaag

SEQ ID NO: 36695 - DNA, 411 bp, Homo sapiens
  misc_feature 27: n = A,T,C or G
gcttcctaatcgttccgacgttatttnactgataacttgaaagcctttaattttttacattctcagttactgtttctcttgcttaactgcgagctcttgaaggtcagtgactgtttttttatactgccagtacccagcacgtcaactgagtacaaactggtcaggaaacactcgttgaatagatgaagacataaatgtttgttcagttgtaggctgttgccaacttcggaaggtcgtctgtttcaaatgtttgagtgattgggctagaacttgcagttccttctcccattaaaaaaaactcatgtaaacgataaattataccacaataacttaatttcatttccaatgattacactccaatcaagtagtggaattattagtaagtccggtcagaggtctgaccagtttctg

SEQ ID NO: 36696 - DNA, 156 bp, Homo sapiens
gtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggc

SEQ ID NO: 36697 - DNA, 464 bp, Homo sapiens
gagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccg

SEQ ID NO: 36698 - DNA, 475 bp, Homo sapiens
ggtgtcacgggcttgtaatcccggctactcaggaggctgacgggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagcttttattgcttttctatatacataagaacttttacgtctcaccagtggaggttgggcagccaagacaccacaatgctggggtgtcttcagaatggacttaatcttgtccttttgctttctgcca

SEQ ID NO: 36699 - DNA, 472 bp, Homo sapiens
ctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccactt

SEQ ID NO: 36700 - DNA, 477 bp, Homo sapiens
ggggagagccaaggaatagtgaatcttagtttagatgacacaaagtcacacttttatgacactgtgaggctctgtgacgtttgctttagtggtgtctgggaagaaagaagtggagtaacgtattgacgatcgctctgaaatccagaaaaggcctgatgttctgctggagggcgggtatgtggggaggcagaggcctttctctccctgcttgtatagctaacattttgttactgttttccgttatttctctttagaaataaaactgttttcttaagcagacattaacctgcagtaaacaccttcacacctgccttttcccatttgcagtaagttgtagcccttaccagtacatgaagagcttcctcattctttcgtctgtgtttgtgtgttaaatgttatacagtcatcctagttcattcaggccactgtaacagaataggataaactgggcagcttcaacaacaaacatttatttct

SEQ ID NO: 36701 - DNA, 196 bp, Homo sapiens
  misc_feature 143: n = A,T,C or G
gaaagatgggggcagagattggagggacgcagctacaagccaagaaaaccaaggattgctggcagccaccagaggctgggagagaggcctgggttgagacggcctcagagcctccagagggagcctggtcctgctgacacctnagttttggagttctgacctccagaactatgagaaaataaatttctgttgttcc

SEQ ID NO: 36702 - DNA, 472 bp, Homo sapiens
  misc_feature 410: n = A,T,C or G
attaggtgattgtattagtccattttctgctgctgatgaagacatacccaagactgggcaatttatacaggaaaaaggatttaatggactcacagttccacgtgctggggaggcctcacaatcatttcgaaaggtgaaaggcacatctcacatggcagcaggcaaagagagagagcttgtgcagaggaactcccccttataaaaccatcagatctcatgataattattcattatcacgagaacagcacaggaaagacctgccgccatgattcagttacctcccactgggtccctctcacaacacatgggaattcaagatgagatttgggcggggacacagtcaagccatatcagtgattaaatgttttaggactgttaggtgttcttgatgaatcaatccttttattatnatgagaggactttctatatccttggtaatgttctttgatctgtagcctactttgtctgatat

SEQ ID NO: 36703 - DNA, 362 bp, Homo sapiens
gggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagccccctggacctgcggcctaagaagacacgtgccatgcgccgccggctcaacaagcacgaggagaacctgaagaccaagaagcagcagcg

SEQ ID NO: 36704 - DNA, 342 bp, Homo sapiens
cattgagcagacctcaagtcaggctcggatgaggtgcaggttggacagcagcgcacgttcatcagccccatcaagtgcagggaagccctgaagctggaggagaagaaacactacctcatgtggggtctctcctccgatttctggggagagaagcccaacctcagctacatcatcgggaaggacacttgggtggagcacctggcctgaggaggacgaatgccaagacgaagagaaccagaaacaatgccaggacctcggcgccttcaccgagagcatggttgtctttgggtaccccaactgaccacacccccattcccccactccagataaagcttcagttgc

SEQ ID NO: 36705 - DNA, 148 bp, Homo sapiens
atagatgatgcaaatgtgagaaaaacactataactgcttccatggtaatgacattctacaaagcatgtccacatggtattaaatgataagtaattgtaatgcacatctggatctgagtacatgaactttatgtttctcagtggatatg

SEQ ID NO: 36706 - DNA, 390 bp, Homo sapiens
atatcagaaggctaaggcagtgttgcagactgcctgcctgagggtagaagacatgccccaacatgcacacacagcccgtaggcaaacacttaataaacttaaaggcatttattagtctctccagttactagctgaccactaagataaccagacagacctctgtggccaaacacacaaaggatacaaggagagactatgaacaactctatggcaaaaattacataaaccagatgaaatggacacacttttagaaaaagaaaaattatcaaaactaagtcaagaaaaaataaaatatctggaaaagtcctgtaacaggagattgaactagtgattttaaaacttcctgcaaagaaaaagtccaggcccagatggcttcaattgtgcattcta

SEQ ID NO: 36707 - DNA, 212 bp, Homo sapiens
  misc_feature 22, 63: n = A,T,C or G
gacacaggtatccggagctggngctgataacagcggaatcccccgtctacctctctccttggncctggaacagcgctacctgatcaccaagtagccacaaaatataataaaccctcagcacttgctcagtagttttgtgaaagtctcaagtaaaagagacacaaacaaaaaattctttttcgtgaagaactccaaaaataaaattcccgatt

SEQ ID NO: 36708 - DNA, 405 bp, Homo sapiens
  misc_feature 151, 268, 363: n = A,T,C or G
aggttgagaattgaaatattttcttgcatcagtattggctagaaaagaaaataaataaaaccaagttaatttagtagtaacaacttacagtgattcttcctgttggaagaatttgcaacaaatcagaatcacgtttttagttgtgcgtgtncgcgcacacgtgtgtaaaaagcactttcgattgtgcctcctgttttctcgagtggggacactttaactacagtttacacctcgggcgcataaagtttttcttctctttctctctggntgtttctgtttctgagtggaccaacagcagcacccacgaggatttgttttgagtatggagctgttgcgggtttgctcctttttcttgctttgcgngctcagtttttacagactgtaaaggagatgtgttgtttgtga

SEQ ID NO: 36709 - DNA, 468 bp, Homo sapiens
atatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcaca

SEQ ID NO: 36710 - DNA, 465 bp, Homo sapiens
  misc_feature 3, 5: n = A,T,C or G
acngnaaaaagagacagctctcacctctagctttctgagatgaggttgtcaaaatctggactcactggatctcctttcctgtgtgtaattagaattttgacaccacttggcatgaagcaacggtgggccagagttctgcgtcatttatccttcaggtgctctctgcagtggatggtttgtgcctcctgaagcaattgcttccctgtgctttgaggtccagcagaggtaacagcggagaaagctggaagaaaggcttcaacaaaagcattaatggtgatgtgaagaatgcaggaaactcccaagaaagccaaatgatatcactctctgcttttccaacatagccagtgtgaggcaggaatcacacacgtttcacagctgggtaaatatgtgatttcacgtgaaatcagagggacaggtgtttctctgtgcttgttaggtgatatggcgtccgcccattttgatggt

SEQ ID NO: 36711 - DNA, 475 bp, Homo sapiens
tactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcacctccactggcatgggctaaccacttctttttcaaaccctctgaacacctttttctgatgggtaacttgcaggaatattctattgggaaaagataacaggaagtacaagtgcttcttgaccccttcctcaatgtttctagccttcactctccattgtcttttctgggctgtattacagccctctg

SEQ ID NO: 36712 - DNA, 207 bp, Homo sapiens
ggatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgc

SEQ ID NO: 36713 - DNA, 464 bp, Homo sapiens
  misc_feature 10: n = A,T,C or G
aagataaatnctttctgttattttagtctagtaagcacttttagtcaaaatatggaaataaaaatgtaaaaagaagaaacaaactctccagatatatggtctcacaatttactgcttaatgaaattgggcatattcacatggagaagattttaattccctgagggggaaaaaagctcaatttttgctagtccaaaaaataaatgaagatttaatttagagttaaattggagttagagaaagagatttaaaagcaataaagtgttttattttaatggtcacttcaattattttcgaattccaggaggtatgaattctgagctttaactagatcaaaggatgttgaaatcttagttaaaaaataaaaaaagagggtctgttggtttttataaaggcaagacgttgtatataataaaaagcctttttttctcccctcacttgtaatcattccttgttgtggaaaata

SEQ ID NO: 36714 - DNA, 467 bp, Homo sapiens
atgaaaagacagcttaaggaagagctaaattctgttaaaatatttggggcatgtttgtgcactgctgttgtgaggatcagcatatgaaattgacatcatggttagtcatggtactgcagcttagggggctacacggttgctgtgtgagtggagagatgcagtgaggcagttgtcattattctaaaaattgtactactttcacttttcccaaagattatataatgttcataatccaccatgaaaacagcattggccaaaggtactgaggctgcttaaaatattcaattctgctttttaatttttaagtgaatttagtttgaaaagcatgattatacaggcctctcaggctgagtgctactttggtaaagttcccagttttcctgccttctgtgacaggatgaatgaggtgggtatggacagtggaggcagctggaatggcaagtgcagaaaataggaacagttctata

SEQ ID NO: 36715 - DNA, 487 bp, Homo sapiens
  misc_feature 1: n = A,T,C or G
ntattttatatttaaaaattgtttcttgacaagctgacttggcacttaagtgcacttttttatgaagaaaaagtacaatgaactgcttttcctcaagcaataattgtttccaatttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgtttttttaaagcaagtcaccttagggtggctttaattgtataagtcaagcacatgtaataaattcaaaacctgcagttaacaggatattagacatcaatcctggtaaccaaatattaaagattctctttaaaaaagactg

SEQ ID NO: 36716 - DNA, 465 bp, Homo sapiens
gattgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatt

SEQ ID NO: 36717 - DNA, 478 bp, Homo sapiens
gtaatctggatgagcgatcttcaaacgtgtgctttcaaactacttaaataccatattcttcctatcttgcctttcatttttatattaccacagatactttcctcatagtcttgccagtgcttgtagaatgcttagaaaaagcttgatgaaccactgggctaagtacacagagggagaggctagcagtatttttaaattggtttctaaattttttatagcttgatggtagataacacatttgcttcattgaagtaatctgaaaaaccaatcctcaaaagacctctcaattagaattcttaaatgacaatgttttctttatcatatatttgagagattgatttaaagaaaaataatgcttgactatctgaaataatattttaaccctatcataaaatctctgcctggtagaacagctgactgtggaagggtaaaatgcagagaaccagtcatttgggatctcccttctctactttgttac

SEQ ID NO: 36718 - DNA, 463 bp, Homo sapiens
gacattgaaagtggagagacttgggctcaagacctccacgtgaccaaacctctgtccttgtcgtcagagctgtccagaaacctaaatggaactgaagtccaccaccctggtctgatctgggagacacctctcctgtcccaaatagagctctctacctacctccctctctgagatacctgcgatctgcaggaggaattactccttttgggcatgacctgtaagcaactgctccattgcaagtctcgttcccaaaccattactgcccatgagcacagtgacgtttaatttcatctttaggattcatttccatcatttcaagcagggtcatcttggaacaggacacaggatagccaaaaacaatccattgatacacttggtgacattaattgagaaaaaaacaatatgggtctcagcgccctgcttccaggttgctcgaggtacccactccctggtaatcacctct

SEQ ID NO: 36719 - DNA, 250 bp, Homo sapiens
  misc_feature 248, 249: n = A,T,C or G
gtctgagattttactgcaccggtcacctgagtagtgtacattgtacccaatatgtggttttttataccttgcccccctcttaccctccccactttgagtccctagtgtccattatgtcactctgtatacctttttgtacccataagttagctctcacttataagtgagaacacacagtatttggttttccattcctgagttgcttcacttagaataatatcctccagctccatccaaaattgctgcgnng

SEQ ID NO: 36720 - DNA, 468 bp, Homo sapiens
  misc_feature 41: n = A,T,C or G
gatcccgtaggagcctctctccctactgctgctacacaagnaccctgagactgacctgcaggacgaaaccatgaggagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacat

SEQ ID NO: 36721 - DNA, 215 bp, Homo sapiens
  misc_feature 30, 59, 63, 71, 74, 190: n = A,T,C or G
ataggtagaatgtaatgcttgtgtgatcgntcaaagcctgaaatgggtacttatatggnaatnctgctcanatngaatgacagctccgtctaaacagattgtttgcaaaggggaggcatcagtgtccttggcaggctgatttctaggtaggaaatgtggtatcctcacttttaatgaacaaatggccttnattaaaaactgagtgactctatata

SEQ ID NO: 36722 - DNA, 462 bp, Homo sapiens
  misc_feature 238, 245, 294, 330, 413: n = A,T,C or G
acctatagaaataattatgttttgaatgtcttcacaagtagcatagttaattgattacctcttaccacactgtccttcataaaatctttatcacattgtgaattaatgaaccagtgcatagtaagtatgttgtacccatagaattagaagttcaagatttagatatttcattattaaattgtttggtttgttattagaccattattgaatggctttgaagattggagacaaatctttngtatttncgtttgcttatgtattacttagtttgaaatagaattttaggaatacagngattacctttctgaatctcttggtcctttaagacgnaatatttttaaaaaattacctgtgattacattcttattatactcttttccattttcttattttttattcctatttctttatgntctgattcctgcagaacctgcaccaaataaagcaaattcaatctctgag

SEQ ID NO: 36723 - DNA, 467 bp, Homo sapiens
gtttgttacagcctttaatctggaagacattatgctaaatgaaataagccaaaccaaagacagacagatactgcttgctttcattcatatgtggaatccaagagtcgaattcataaaagcagagggtcaaatgttggttgcaaggcgctgggagcaggaggaagtagggaggtgttggtcaaaggatacaaattttcagttatgcaatatgactaaaccgtagacatttactgtattgcctatagctaacaatactgtattgtttacttaaaaatttgctaagatggtagatcttaaatgttcttatcacatgcaaataataatggtaataataataaaataaaagaatgggtggaaagttttggaaggcacggcagtgcttatggcatagattgtgatgatggttttacaagtgtacatttatctccaagctcattaagttgtatgcattgaatatacagctttct

SEQ ID NO: 36724 - DNA, 288 bp, Homo sapiens
  misc_feature 288: n = A,T,C or G
atcataaattaaatgagaatttctgcttatcagtattttatataagcactgtctggaaattctacttaggacaatatttaagtagatatgaggcttaccttctggaaaagagattacaaaattatccttgttaattaattaactaattaagtccccaaaatgagaagagattcaattactatcaataatttgtagtaaagtgactgaaaaggaaatatataagctaatagattgattgccgtcctcaacaagttagcacatacttttatttttaaaaagtcttcacan

SEQ ID NO: 36725 - DNA, 348 bp, Homo sapiens
  misc_feature 22, 24, 25: n = A,T,C or G
agttttctgcgtaatactcagnannttggttgagtgtgtattgcatgcttcctttctttctgccagttattttgtgctttgttgactaattttggcctataataggttaaaatggtttatgaatgatagtatttgacctaccttgaagcaagggtatcctgttagatgttaacatgcaggttttagggttgccagagaaactatcaaataaacagtccaggaaacaatataaagattagcccagttaggaagtggcagaaatcgcttgacgtcacaaacatccctgtatccttagagaagtggccaacaattctctaagctagaaaaccccacagctaaaatcttatc

SEQ ID NO: 36726 - DNA, 160 bp, Homo sapiens
  misc_feature 160: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctcgtn

SEQ ID NO: 36727 - DNA, 160 bp, Homo sapiens
ggaaattgaataaaagagaagtaagaatcaaatcctgcagctgaagaattcaatgaatgaaaaaacatacagtggagaatttcagcagcaaacttgatcatatgtaagaaagaatctctcaacttgaagataggttatttgaaattaacaagtcagagac

SEQ ID NO: 36728 - DNA, 340 bp, Homo sapiens
ctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttggtatcttttcaatcaagctgtgtgcttaatttactctgttgtaaagggataaagtggaaatcattttcca

SEQ ID NO: 36729 - DNA, 279 bp, Homo sapiens
gaaatggaataatgaaatggaaatgatgagctgagatgcaatgagttgaaatgagatgaaatgatgaaatgatgagatgaaatgatgagatgagatgtgatgaaatgatgacatgaaatgatgacataaaatgagatgaaatgagatgtaatgatggaatgagatgagatgaaatgagatgaaatgatagatgagataaaatgatatgaaatgatgagatgaatgatgagatgatgagatgaatgatgaaatgaaatgatgagatgagatgatgaaacg

SEQ ID NO: 36730 - DNA, 464 bp, Homo sapiens
gttccccatagaaactgaacctaaacttcaaatttttattatctaagctataataataggcggagtcgatctggaacatacagctcgagatcaagaagcaggtcccgcagtcacagtgaaagccctcgaaggcatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtattggactca

SEQ ID NO: 36731 - DNA, 476 bp, Homo sapiens
  misc_feature 390: n = A,T,C or G
ggcaaactttttgatctcgtgacccctttatactcttaaagattattgaggatcttaaagagctttttgtttatgtgaattacatttattgatacttaccatccaagaactgaaaatagagaaaataatttaaaatacatgtgttttaaaatattataaacccattgcatcctaacataaataacatattgtaattaaacaaaaatcttccaaaacaaaaaccagttagaagagtggcattctttttatttttgcgtatctcttttatgtctggcttaatagaaaacagctggattcccagctctgcttctgattcagtgtgtggtggtatcacacatcatgtaacccctggaaaactctactatttgtcaaagtattatgaaaatttgntttgacctcatgggtttccttgggaagagtcgacccctgcaagggaccacggaccacacttgtgggaactgctgtgctaaatcatg

SEQ ID NO: 36732 - DNA, 135 bp, Homo sapiens
ggaccactttggttttcttttttgcgtgtggcagttttaagttattagtttttaaaatcagtactttttaatggaaacaacttgaccaaaaatttgtcacagaattttgagacccattaaaaaagttaaatgaac

SEQ ID NO: 36733 - DNA, 326 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttt

SEQ ID NO: 36734 - DNA, 143 bp, Homo sapiens
gcagtgaccaaagacttgaccactcaaagtccagctccccagaacactgctcgacatggacaccggtgtgattgaaggtggattaaatgtcactctcaccatccggctacttatgcatggaaaggaagttggcagtatcatcg

SEQ ID NO: 36735 - DNA, 220 bp, Homo sapiens
gtgggacactcagggaaagggctgggtaaaagaaatacaaccaagctagagaaagtttcagaaggaaaaaatatcacatattcctacctcctcgagagccaggaaaagaagccttatcatcacctgattgctttttccatgtgataggaatgaccggactttctttggaccacgcctttattaatcttgattatgtacaataaagataaaaactttgtag

SEQ ID NO: 36736 - DNA, 144 bp, Homo sapiens
ggtggaatattggggccttaaatttcctgcctgtagaatgaggcatttgggctaggggagtggttcctagactttttgtgggataatcaatgaatttttataaaacagaatatcacaaggccaccagctttttattttgacaag

SEQ ID NO: 36737 - DNA, 464 bp, Homo sapiens
ggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccactttcttccgcgaattggccgaggagaagcgcgagggctacgagcgtctcctgaagatgcaaaaccagcgtggcggccgcgctctcttccaggacatcaagaagccagctgagat

SEQ ID NO: 36738 - DNA, 476 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaaggatggcaatggctatattagtactgcagaacttcgccatgtgatgacaaaccttggagagaagttaacagatgaagaagttgatgaaatggtcagggaagcagatattgatggtgatggtc

SEQ ID NO: 36739 - DNA, 462 bp, Homo sapiens
ggaggtataggaagagatggaaacctgagggatgtcctggctttataacaccccactgcctcgaaaacgaatccagtctcacaaaagtgagaactcactactgtgaaaacagcacgaagccatgcatgagggatgcaccctataacccaaacacctcccaccaggctccatctcccaacaccaccacaattggggatcaaatttcaacatgagttttggtggggacaaataaaccatagaagcaatattctgacctgctgatgttttgtatgcctgtgttctgccaatgtattctggagggttcctgacacagtgtcagcaattactgggggctttttgaaatccagccctctttattatatcaataaaactgacttgataatagctattgatgtcaataaagtttaaatgttttaccacagtcattatgtcattgggatgctaattgacattaataccaga

SEQ ID NO: 36740 - DNA, 453 bp, Homo sapiens
ggaatctacgagataaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtgaaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctca

SEQ ID NO: 36741 - DNA, 464 bp, Homo sapiens
  misc_feature 428, 431, 434: n = A,T,C or G
caagagacgggcattgagcagctctgtcattcgtgaacttaaggagcagtactcagatgctccagaggaaatccgtgatgctcggcatccccatgttacccgccagagtcaggaggaccaacacaggattaactatgaggagagcgtgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattattggggtgtcatatttgtatattttttttgtcatcctgagatacttctaatttcattgatatanggnggntttccctggaattcattaattgtttgcttt

SEQ ID NO: 36742 - DNA, 437 bp, Homo sapiens
gacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaaactttttatttcctcagagtcttccttaatcctatggaacaagaagctgccactgaatagggcccagtataggggcttgcttttctactccctccccccaatataaaaatatagactttttttttgtggtccc

SEQ ID NO: 36743 - DNA, 464 bp, Homo sapiens
  misc_feature 5, 28, 49, 84: n = A,T,C or G
ggtgnttctccggacttcgagccatggnggtgacggaagcgagcctgtngcgccagtgccccctgcttctgccccagaaccggncgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagag

SEQ ID NO: 36744 - DNA, 100 bp, Homo sapiens
tcattattaccctcactgtcaacccaacacaggcatgctcataaggaaaggttaaaaaaagtaaaaggaactcggcaaatcttaccccgcctgtttaccg

SEQ ID NO: 36745 - DNA, 476 bp, Homo sapiens
  misc_feature 435: n = A,T,C or G
ctagaattcaggcttaacctatgcagtatttctggctgtatcactgaatctctccacgcaccctctgtgccagctacatcagaatacttgctgcttcccaaatgtgctgctccatctggatggcgagtttttccctccttctccagcagtcacattccttatcgatcagccttcgggttccagtgccactcctgccaaaaagcatgttctctgacttgttctcccctcacctctctaggttagattgaatcgtttctttctttatattctcttagcattttgcttttgcttctattactacactttaaaaattctatacgtgaaggttatatttattaaaattgaccaataaatgttaattgcaatacatttgttgatttgacttactgaacgtttctacttccatcctgtttttttagctgtgttttagatggntaaaattgccataatatggtcttagatcagcgaaatattat

SEQ ID NO: 36746 - DNA, 239 bp, Homo sapiens
atgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcac

SEQ ID NO: 36747 - DNA, 481 bp, Homo sapiens
  misc_feature 17, 42: n = A,T,C or G
tatggccgggaattgcncgatacagaaagccatcggatgtcnatcggatgcaatgcagagagatgtctggctactgtgcagtaaagagatggtagagacagggctggggtgagcagtgaggggtccctgcagtggatctggagatacattaacatggtctcccgcctcctcagagacctccttcaagtcttgcccgctacagaaagccttactggattctgtttgccttgagcaatctgccagagccctgaaatatagctgttattttaagtctctttgcagtctgtgttctctcgtgataacttcctattgccttcttgtctctttaaaaatcacatattgagcttttcatgcacttgcctcttattttcccaagctcttccagttcatacctcctcatccccccaggtctatcagtgccttcggggtttggaacctttggggtacactgatggtcacccaacatgggaagaacaccatg

SEQ ID NO: 36748 - DNA, 444 bp, Homo sapiens
taaagcagaattgattcttatgcaacattctggtaagaaaaaagtaaaattacatttttgtctttaacatataggcccttctcattaaatacagatttaacaatttactgatatggaaattctcaggaaaaaaaccttcaaaatatatttataatgtcaagttgtatgtgtgcgtgcatgtgtgcatgtgtattttattttctctctaaagctgtttgaaagtccaggaaagcaacaatatacctttagcttttgtaacttcaggaatccatagtaataaggcactgaggaaggagggagtggttctatagttaactttgaccgtaatttttccttagagacctcatgcatttctctttatcttcatacccaaaagaatgtgggtcatccaaagactcaggatgcaatctatattaacactttcccaaagttgcccagaagcca

SEQ ID NO: 36749 - DNA, 478 bp, Homo sapiens
ggtatctgattctgcctgagaaagcaggatttatgggaaggaaaacttgtctaaggctcatcaagatggcccgacccagagtcacctaagagaactcttccaacttaaatgactagggtgtgtaatcagttgcttcttattctgtgtctcagatttcctagtccatgacatttaatagtgagtatagagtaggatattctatacattttagtatttggcccttggaaacaaagttaaataccatgtcactcagaagactctcaaagtttgtgtataaatggcgaagtatgcactatgagagattctaatccattcacatcattcttgagttgtgcaaatacacttggctttgatttcacttggtgatctaaatttgtttatttaagctgcaagaaagttacattaatttggaatgtgtcatcacttggacccagtatatcagatttttattgagtaaaatgttaaaaataataagtgt

SEQ ID NO: 36750 - DNA, 239 bp, Homo sapiens
  misc_feature 5, 10, 30, 32, 183: n = A,T,C or G
ggatncagtnataagatggaaaaagactgntnaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagnaaaagactgtaaatagatccatccaaatgatttctctgtacaaatgaatgatacta

SEQ ID NO: 36751 - DNA, 296 bp, Homo sapiens
  misc_feature 20, 158, 184, 188, 216, 233, 264: n = A,T,C or G
tcccaacactgccaacgagncagcatgaccttcctacgcctgctgtccacggaaggctcccagaacatcacctaccactgcaagaacagcattgcctatctggacgaagcagctggcaacctcaagaaggccctgctcatccagggctccaatgacgnggagatccgggcagagggcaatagcntggntcactgtacactgccctgaaggatggcngcacgaaacataccggnaagtggggcaagactgttatcgagtaccggnacagaagacctcacgcctccccatcattggca

SEQ ID NO: 36752 - DNA, 352 bp, Homo sapiens
tggttcaggacttgtgttgggtgctaaatgagaagctgggttgaaatcaggcccatgggtaatagttactattggagtttcaacaaagagtgaatagagctggaggagttggggggcagacaataaatgtgaaaggtatgaggaggatattaatgcttgaaggttgtgagagctgtaaagggtaagtggagcatagcctgtgatttttgatggcctctagaagtatttaaatggcacaaacatgagggccagcccagaattgtgaagttgagttgtttggatagaaaggctatagggcacggtcccagctcttgtgtaagaattcccactgcacagtcctgtactttggttg

SEQ ID NO: 36753 - DNA, 349 bp, Homo sapiens
  misc_feature 5, 7, 32, 33: n = A,T,C or G
ggggncnaggccaaaaagaaagaagtggtccnnaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatc

SEQ ID NO: 36754 - DNA, 322 bp, Homo sapiens
  misc_feature 5, 31, 34, 318: n = A,T,C or G
aaggnccaaccccatctctatgaaaaatagnttnattagggctgggtgcagtggcccacacctgtaatctcagcacttcgggaggctgggcggttggattacgaggtcaaaagattgacacaatcttggcccacatggtgaaaccccgtctcgactaaaaatacaaaaattagctgggcgtcatggcacgtgcctataatcctactacttgggaggctgaggcgggagaattgcttgaacctgggaggcggaagttgcagtgagccgagatcacgccactgcactccagcctcgcaacagagtgagactctgtctcanaaac

SEQ ID NO: 36755 - DNA, 136 bp, Homo sapiens
tgaaaagaagcctgcagagaagaaacctactacagaggagaagaagcctgctgcataaactcttaaatttgattattccataaaggtcaaatcattttggacagcttcttttgaataaagacctgattatacaggc

SEQ ID NO: 36756 - DNA, 160 bp, Homo sapiens
  misc_feature 5: n = A,T,C or G
atggnctttgctatcttttaactagtctgatattcttatactttagttatacttttggaatttgatacaaggttgagtggggtgtgtgggtgtatgtatgagtgaaacagttctcaaaagaatgtaagaaaaaccatttttataaaattgtgacttttcg

SEQ ID NO: 36757 - DNA, 331 bp, Homo sapiens
  misc_feature 2, 8, 34: n = A,T,C or G
gnagggcngtttgactggggcggtacacctgttnaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccact

SEQ ID NO: 36758 - DNA, 441 bp, Homo sapiens
  misc_feature 18: n = A,T,C or G
tatggccgggggtgttcnatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaataactcacctggcatcttacatctgaaataaggaatgatat

SEQ ID NO: 36759 - DNA, 150 bp, Homo sapiens
  misc_feature 5, 32: n = A,T,C or G
cttgncaatttaactgttagtccaaagtaggntcagctctttggacactaggaaaaaaccttgtagagagagtaaaaaatttaacacccatagtaggcctaaaagcagccaccaattaagaaagcgttcaagctcaacacccactaccta

SEQ ID NO: 36760 - DNA, 418 bp, Homo sapiens
caagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttact

SEQ ID NO: 36761 - DNA, 165 bp, Homo sapiens
atcctcaattttatattagaaattcacacactagttaaaatggaaaaactgccaatacctgatttctgtcccctgtttttccactcgcagtcatatatgtagttaccttttgaccccgtgggggaaaatacatctaacagagaactatcaataacagaaagaaga

SEQ ID NO: 36762 - DNA, 189 bp, Homo sapiens
  misc_feature 24, 90, 110: n = A,T,C or G
tgagggggcaggcggagcttgagnaaaccgcagataagtttttttctctttgaaagatagagattaatacaactacttaaaaaatatagncaataggttactaagatatngcttagcgttaagtttttaacgtaattttaatagcttaagattttaagagaaaatatgaagacttagaagagtagcttg

SEQ ID NO: 36763 - DNA, 284 bp, Homo sapiens
  misc_feature 284: n = A,T,C or G
aggagaggagaaagtccctaatcaacattcatgtcttgacctaatttgtagtgtactttcattgtcttaattacctcctatgttttgtaatgaagaaatgttagtttccatttattccagaaaaaactctgtggcatttttccatccaaaggtagatagatagcttctgcagtgagagggaaagatagttgttttgaatgcgaaagggataacttttctgttggtcctgccttttctgtttgcatattgaggcactattttctgaaaataaaaacaaacaacan

SEQ ID NO: 36764 - DNA, 265 bp, Homo sapiens
  misc_feature 5, 6, 31, 59, 130, 213, 258: n = A,T,C or G
ggaanncctggtgcgaggtggagggctaacnttaggaaagaactacattcttcagaatncagtgatgaaaattcattttgaaactcaaatattttcattttggatattctcctgtttttattaaaccagngattacacctggccatccctctaaatgttctaggaaggcatgtctgttgtgattttgatgaagacagaattatttttctctgnagaaacacagataccactttatcagggaagttagtcaaatgacanatggggg

SEQ ID NO: 36765 - DNA, 180 bp, Homo sapiens
  misc_feature 32: n = A,T,C or G
atatagcgtttgttcaacaactgtttattgancacctcatatgcaccaagcaccattctaagtgtgaaggatgtagcattctaagaaacagtccaagttgtcaaagcagtaactttaaatctaccagggaattcagacattaaaaactgtgtaatgatttttttatatgaccagtcctat

SEQ ID NO: 36766 - DNA, 490 bp, Homo sapiens
  misc_feature 46, 48, 480: n = A,T,C or G
tatggccggggagcacccccaagcagccatagataatatacaagtntnaggggtgtcactgtgctccagtgagactttatttacaaaaacagacaataagccatatttggcctgaagactatagtaggctgtcccttgattggatgcatcaaaaacggacatttgacctgtaaacctgacacctcgctgggtaccactccgtctgaccttgagcaaaccatttatctgcgagaaacaggaataaaaaatatatacctgcccttactaccttgaaagatggtgttgtaaggatgaaacaagatataatgcatgtgaaagcactttgaaaatttcgaaactccttacgaatgtgatgatcggctctacagtcattctggttcaccttgtggagtgtgacttcttcacctttttaatcacattgggctttcatgagcgaaatgagtgtgggggaaagctctcttattttctgagtaatgtggnttgtctgtac

SEQ ID NO: 36767 - DNA, 130 bp, Homo sapiens
aatgcctcgtcatctaattagtgacgcgcatgaatggatgaacgagattcccactgtccctacctactatccagcgaaaccactagcagctgccaatgtattctgaacaaataaattaatgctatagctg

SEQ ID NO: 36768 - DNA, 234 bp, Homo sapiens
  misc_feature 23, 130: n = A,T,C or G
tggctaactttcaggggcctcancattccatatgtcttcagtggattgatgaatatcaggttaatttgtgcctgccccagccatctctactttattctgaggtattccacaatcctcttgttgcaaggtnctgctaaaaaaaactcaaaattgtgtatcaaatattttctttcaactgtaaaaaatcatctgtgttaaagtgaataaaaagtgcattttgaaattaaaccccag

SEQ ID NO: 36769 - DNA, 320 bp, Homo sapiens
  misc_feature 22, 103, 132: n = A,T,C or G
ctgaggtgggagaattgcttgnacccgggagttggaggttgtggtggaccaggatcgtgccaccgtactccagcctgggcaacaggacaattgtgccactgcnctccagcttgggtaacagagtgagacctnacctaaaaaaataaaataacccatacagtaaaattgacctgaccacaattatctcactgcagcctggaactgttggcctcaagcaatcctctaacctcagcctcccaaagtgctgggattacaagtatgagccaccatgcccagcaacctcaatgttaattttaaaaacttttttttttagaagaatg

SEQ ID NO: 36770 - DNA, 498 bp, Homo sapiens
  misc_feature 26, 475: n = A,T,C or G
tgttaatgtatgaagagaagcatccngttatgaactcagtactctcacaaaaagacacacaggaaactttctgtggcctcaaatgaaacattgaggaataagtaatattagggaattacctaacgagcacatgggaaatagctaattcataaccacaaatagaatctatttcaaatggcaagggaagcaaaatccctgtcattcccacacattgatttttccttggtagattgtaaaggtctttaaggtgttggatgaagagttctgaatcagctgtgaaataagacaaaagagggaggagagaaagcagatggaaagccaaaatgtcacattcgttttagataaagactagaggatgtagtttagacccacaggtaagtgggctccttaacactaacctcagaattagagacatttcccaccaacatagagtaagaaaacacaggtctccccagtgcgaccagcctcactttgnggcctgataacgctttttgtagg

SEQ ID NO: 36771 - DNA, 498 bp, Homo sapiens
  misc_feature 69, 70: n = A,T,C or G
aaaggcgatctgtctgatgtcctgtgtttggtgcctaggtgggcttggtgcttgcatttcctgcgttgnngtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactga

SEQ ID NO: 36772 - DNA, 415 bp, Homo sapiens
  misc_feature 366, 395, 412: n = A,T,C or G
aagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatngggaaattagaagataaaaacatactttnagaagaaaaaagataanttt

SEQ ID NO: 36773 - DNA, 393 bp, Homo sapiens
  misc_feature 171, 173, 174: n = A,T,C or G
acctgcacctactcagctatcccaggaccagcttgaggctgaagaaaaggcaagatcccagagatcacggcagacctcactggtctcctcccgaagagaacctcccccgtacggataccggaaaggctggatacctcggttattagaggattttggagatggaggtgcttngnnagagatccatgtggcccagtatccactggatatgggacgaaagaaaaaaatgtcgaatgcgctggccattcaggtggattctgaaggaaaaattaaatatgatgcaattgctcgacaaggacagtcaaaaggcaaggtcatttatagcaaatacactgacctggttccaaaggaggttatgaatgcagatgatccagacctgcaaaggcccgatgaaga

SEQ ID NO: 36774 - DNA, 495 bp, Homo sapiens
  misc_feature 6, 25: n = A,T,C or G
caaagnaactatgaagatgattttnaagctctaatttatatagtcacccataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatagttattttaaccaaaatgttactcacattaaatgtttattctttaaaatgaatgtattatggtttttaacccacaaatgcatactta

SEQ ID NO: 36775 - DNA, 486 bp, Homo sapiens
  misc_feature 450, 459, 461: n = A,T,C or G
tgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgngtctgggtncntaaatatatatacatatatatatac

SEQ ID NO: 36776 - DNA, 209 bp, Homo sapiens
  misc_feature 15, 16, 91, 111, 154, 194: n = A,T,C or G
ctgaggtcaggagtnngagaccagcctggcacaacatggtgacaccccatctctactaaaaatacaaaaattagctgggcggggtgggggngcctgtaatcccagctactnaggagaattgcttgaacccgggagatggaggttgcagggagcngagattgcaccactgtactctggcctgggcgacagagcangactccaacccaatg

SEQ ID NO: 36777 - DNA, 401 bp, Homo sapiens
  misc_feature 53, 64, 97, 113, 176, 192, 266, 336, 353: n = A,T,C or G
agctaggattacaggcatgagccccccatgaccagccttcagttttaacattngagttagtggngaacattaagatttattattctaggaatgcagngaataaaataggaagngtaatttattaaggggtttaaaaatatgtttgaatgtttcttttatgatcttttttaaaagtnggatgtatgattttgngttttgttttagttgtcacaacttggacaaaagtaacacagaagaaccttactatgataatctacttggaatgnggataaatgtaaaaagaagaaaagttagaagagcaatatgtttccttctctgtaacagggtcctaacagngaaaatcagagttattngttaatttttaagggaaattatatacttaatatgtattgattaaaaga

SEQ ID NO: 36778 - DNA, 155 bp, Homo sapiens
tacttttggccaagagtaatgaaggcggctaaggagaagcgccaggaacaaattgcgaagagacgcagactttcctctctgcgagcttctacttctaagtctgaatccagtcagaaataagattttttgagtaacaaataaataagatcagagtc

SEQ ID NO: 36779 - DNA, 386 bp, Homo sapiens
  misc_feature 25: n = A,T,C or G
acatggtgaaaccccgtctctgccnaaaatacaaaaaattagccagatgtggtggtgcacacctgtagtcccaactattcggcaggctgaggcagtagaatcgcttgaacctgggaggcggagattgcagtgaaccaagatcgggccactgcacttccagcttgggtgacagagcaagactccatctcaaaaaaattataaataactctttgcaaataggaaagtgaagctcaagggtaaccagtgaggctatgaaattgccagtgaattaagactagggctagagtcaacagtccagaacccctatccgtatgaacaggggcccgtttctggttgaaatcaaggttaggatgcaactgagaaaataaaagactgcactttggaga

SEQ ID NO: 36780 - DNA, 258 bp, Homo sapiens
gaaaagacatagaaaaggcttgcccatcctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgc

SEQ ID NO: 36781 - DNA, 181 bp, Homo sapiens
  misc_feature 105: n = A,T,C or G
aagggcaaaagctcgcttgatcttgattttcagtacgaatacagaccgtgaaagcggggcctcacgatccttctgaccttttgggttttaagcaggaggtgtcangaaaagttaccacaggggcccctttacatgccctctcccttttataaaattttccattaaaaaccacctattttct

SEQ ID NO: 36782 - DNA, 466 bp, Homo sapiens
  misc_feature 15, 43: n = A,T,C or G
tatggccgggcgaanccccaaggggtaggcaattctatgtagnttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtaggagaaactac

SEQ ID NO: 36783 - DNA, 362 bp, Homo sapiens
  misc_feature 22, 23, 333, 351: n = A,T,C or G
aaccgcctgcaggaggctctgnncctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgngtgttcaacgactgccgngacatcattca

SEQ ID NO: 36784 - DNA, 111 bp, Homo sapiens
gaatgctacataaaccctcccctttgaatctgagggggccactaatttttttcctagagtgctactcttatatattgagaatatttttccccctaatgcttggagaatgat

SEQ ID NO: 36785 - DNA, 100 bp, Homo sapiens
aaagagaaaaaaatttgtttagcccttagattgcaaagagaaataacttaaaagaatttggggaaaattattagcttgaaaatggcatatcattttaatg

SEQ ID NO: 36786 - DNA, 498 bp, Homo sapiens
  misc_feature 24, 134: n = A,T,C or G
ccaaaatgtttggaaacagtatcntttgacaaagaaaaatgatacctctctttttttgctgttccaccaaatacaattcaaatgctttttgttttatttttttaccaattccaatttcaaaatgtctcaatggngctataataaataaacttcaacactctttatgataacaacaccgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaag

SEQ ID NO: 36787 - DNA, 491 bp, Homo sapiens
  misc_feature 32: n = A,T,C or G
aatgtacataactggtattatttctactttanttgtttggtagaattcaccagtgaagccatctgggcctgggctttcttgcagaaattgatatgatgattctaaaattcatatgggaatgcaagggacccagaatagccaaaacaatcctgaaaaagaataaagttggaggactcacaattcccaatttcaaaacttaccataaagctacagtaatcaaaatagtctgttactggcataaggatagatacatagatcaatgggatagaactgagaattgacaaataaaccccacacatccatggtcaatttttggcaagagaaccaagaccactcaatgggaaaagaatagcctcttcaacaaatggtgctgggataacctgataaccaccttcaaaagagtgaagttggacccctacttcactccatacttaaaagttaagtcaaaatagatcaaagacttaaatgtaagaactaaaactataaaactc

SEQ ID NO: 36788 - DNA, 494 bp, Homo sapiens
  misc_feature 22, 23: n = A,T,C or G
cctcctttacctttcagtgcannttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagttcacaaatccttcaaaataaaaagtaatgac

SEQ ID NO: 36789 - DNA, 159 bp, Homo sapiens
  misc_feature 48: n = A,T,C or G
atttttattgtcttatttttaattttgatttttaaaataaaatttacnctctttactatgtttaagtgttagttgaatagtgttaagtatagtcacataagtcagtatacagttttaaacaatgtatataacaatatatattaaacataggaattttgg

SEQ ID NO: 36790 - DNA, 491 bp, Homo sapiens
  misc_feature 6: n = A,T,C or G
ataganccgtagattatgaaataagaaaactttttggcatgttaaatgctctttaaaggcttttaactcctgtctggtggagcaaatggacaccatctgtataagaaagccagataccaagaaactgagagttttacttagtgaaaccttccactacttatgaaaagtcaaatatcatgtataactcatccagatcaactagtccctagacactgatttttgggaaggatgtaagagaattactgactcagatttagggtttaaagactattgagaaataggaaggtattgagagattattgggtttcatcagagcagacttaagtagcctggttgattttagatttgtcacagcaaaatcatgcttggatgctcgaggcctggcagaaccttgctggtctctgtagggtgggataagtgaagcaacattaaaccaggtgcagtccttaatttctcaggtaacataactttagaaaaaacaattctaatac

SEQ ID NO: 36791 - DNA, 162 bp, Homo sapiens
aggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtg

SEQ ID NO: 36792 - DNA, 463 bp, Homo sapiens
  misc_feature 2, 25: n = A,T,C or G
gncggttctctcctttccagtcgcngacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaac

SEQ ID NO: 36793 - DNA, 335 bp, Homo sapiens
  misc_feature 22: n = A,T,C or G
atgtctgttgcttaaaaaccangtctgccttggtttgtcccattgtagcactgcctttcaggacagatgcagggaaacagtaacatcagtgttactgagagactcctattatatattcacactcaataaaaggcacatttgttgcaaagaagtctaaaattccatggaattctgtgtgttgtgattgattatcgatcttacaaatgattatgtgtattaaaattcatttaatgtaaattttcttaaattagggctctattaaaatttagatagggactaagttggaatattttaaagaaagcatttgctgaaatatttatgagataaatgtaaac

SEQ ID NO: 36794 - DNA, 127 bp, Homo sapiens
  misc_feature 26: n = A,T,C or G
atgcttgcaaaaatgtatgttatccnttgtctgttttattatattaagtggtgtataaagtattctgttgtgtttttatgtttctcaaataagttcccctttaaaaaataaatatctttaagttttt

SEQ ID NO: 36795 - DNA, 129 bp, Homo sapiens
  misc_feature 19: n = A,T,C or G
gttttagtacccacttgtnccataatatcaagattactaaaaatgggggaaaggacttctaatctttttttcataatatctttgacacatattacagaagaaataaatttcttacttttaatttaatcc

SEQ ID NO: 36796 - DNA, 110 bp, Homo sapiens
cccagtatgaagagatcttaatgatactaacctctgttaatgatgctagtctgaaatcacacccgaactagggtcatttctacagcatctttggcaggatcatccatctc

SEQ ID NO: 36797 - DNA, 146 bp, Homo sapiens
  misc_feature 26, 50: n = A,T,C or G
ctctcatcatttcagcaccaaggccnataaattagtggcagagtaagggngacttgatgagtacatccaattgttgacatagttttgggtgggagaaattttgctattatatcgacttcttaaaatagtctagtgggattcacatg

SEQ ID NO: 36798 - DNA, 302 bp, Homo sapiens
gatgatcaaccaaactaaggtaccagggaacagtcctggagaaacagagctatgtgacctttcagacagataattcgaaatagctattttgaggaaactctaagaaattcgagataacacagagaaggacttcagaattctatcagataagcttagcaaagagattgaaatacttacaaaaaatcaagcagaaattctggagttgaataatgcatcataatttcttaacagcagaatttatcaagcagaataaagaattagtgagcttgaagataaactctttggaaatgcacagagaagac

SEQ ID NO: 36799 - DNA, 478 bp, Homo sapiens
attagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaatccactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggat

SEQ ID NO: 36800 - DNA, 243 bp, Homo sapiens
gatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcaggagc

SEQ ID NO: 36801 - DNA, 160 bp, Homo sapiens; identical to SEQ ID NO: 27886

SEQ ID NO: 36802 - DNA, 340 bp, Homo sapiens
aggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccct

SEQ ID NO: 36803 - DNA, 264 bp, Homo sapiens
  misc_feature 30: n = A,T,C or G
cacacctgtaatcccagcactttgcaaggnttaggtgggtggatcacttgagggcaggagttcaagaccagcctgaccaacatggtgaaaccccgtctctactaaaaatacaaaattagccggggttggtggcacatgcctttaatcccagctactgtagagggctgaggcaggagaatcgcttcaacccgggagacaggttgcagtgagccaagatcacgccattactctccagcctgggcaacaagaacaaaactctgtcgc

SEQ ID NO: 36804 - DNA, 124 bp, Homo sapiens
  misc_feature 13, 21: n = A,T,C or G
atagagaaacagnacccaagnaaatgtgctcaattgcaatgggccacatacctagatctccagatgtcatttcccctctcttattttaagttatgttaagattactaaaacaataaaagctcct

SEQ ID NO: 36805 - DNA, 277 bp, Homo sapiens
  misc_feature 274, 277: n = A,T,C or G
ctgtttgcagatgacatgattgtgtatctagaacacccctcgtctcagcccaaaatctccttaagctgataaggaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcancan

SEQ ID NO: 36806 - DNA, 259 bp, Homo sapiens
  misc_feature 12: n = A,T,C or G
gacagcaccggnaaagtgaagagtcagaactaactttggtctcagcgggagccagtggtgatgtaaaaatgcttccactgcaagtctgtggccccacaacgtgggcttaaagcagaagcctcacagcctggcacgaaggccccgtctgggttaggtgactaaaagggcttcggccacaggcaggtcacagaaaggcaggtttcatttcttatcacataagagagatgagaaagcttttattcctttgaatattttttga

SEQ ID NO: 36807 - DNA, 105 bp, Homo sapiens
aagctctagcaaaataaaacatagcaaatggcatcactgtgtttgacttcttgtgaaatttctgtactttgtatataaaatacataaaacaatagattagaaatc

SEQ ID NO: 36808 - DNA, 440 bp, Homo sapiens
atagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcaccggtctaaatctttgtgtactttatttgtaaattatttgccctggagttttagaaaatagtttctgaattttaaacttgctggattcatgc

SEQ ID NO: 36809 - DNA, 168 bp, Homo sapiens
aaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttt

SEQ ID NO: 36810 - DNA, 168 bp, Homo sapiens
tatggccggggaggagccaactaatgaagaaatgaataataaattttgacactgaaaaacattttattaataaagaatattgacatgagtataccagtttatatataaaaatgtttttaaacttgacaatcattacactaaaacagatttgataatcttaaaaaaaat

SEQ ID NO: 36811 - DNA, 181 bp, Homo sapiens
  misc_feature 1, 5, 34, 35, 36, 44, 91, 123, 171: n = A,T,C or G
nggantctaagaaggtgataagactaaattaacnnntgtagaanccatgaattttagtgaaaataaaatgaatccccttttgccatatctnctccagtgcataggctcactgcctcagcaggntccttatccaagaatgcatgtggttgaggccacagggaaccattggtnaggatttctc

SEQ ID NO: 36812 - DNA, 384 bp, Homo sapiens
  misc_feature 16: n = A,T,C or G
atggccgggatccaantgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatac

SEQ ID NO: 36813 - DNA, 291 bp, Homo sapiens
  misc_feature 4, 19, 27, 33, 34: n = A,T,C or G
gctngctaatcaattgagnccagtacngccttnntaaagacatagtaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgc

SEQ ID NO: 36814 - DNA, 396 bp, Homo sapiens
  misc_feature 3: n = A,T,C or G
ggnacctgggaggggctgcatgtacactgtgtttatgggagttgtatgcatgctcacctgagctttcttcccttaccagttcattattcctagaggaaggtcatataccagttaaactccaccattttgcctcttagtgcacatgcttgagcccacttgcccaaatcctgagatcttattaggaagctgctgatcaccagtttcaggttttttctgtctactgggagactgccattcccatgtgccacctatgaccaattattattttagtgagacatttaactacttcctgaccatcacctgatggtcgactgatgttcttagtttgatggcgggtgggggggccctctcctgccctacttgtgtctgactagctacctactgtgacactcctga

SEQ ID NO: 36815 - DNA, 354 bp, Homo sapiens
  misc_feature 353: n = A,T,C or G
gagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatganc

SEQ ID NO: 36816 - DNA, 131 bp, Homo sapiens
gaaaaccccttagtatgaagttgataagaggaatttggtataattatggtgggtgattattttttatactgtatgtgccaaagctttactactgtggaaagacaactgttttaataaaagatttacattcc

SEQ ID NO: 36817 - DNA, 296 bp, Homo sapiens
  misc_feature 15: n = A,T,C or G
gggttgatgcacagnagaagggggtaagaacttaaagttaatatttagaatctttagaaaaaaagattgaaagatgatttttactacattcacattttgaatatatgtgtatatgtttacacaaacacacacacacaaacaaaaaagttagaggaaaaaactgctcagtagtttattttgaaaataaccagcaaattttagtgagacttttttttaaaattttttaaatttttattattatttttgagacagagtcctgcacttcagcctgggcaacaagggcgaaactctgtttc

SEQ ID NO: 36818 - DNA, 417 bp, Homo sapiens
tatggccgggggagccccaacaggctgccgctgaggggctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttg

SEQ ID NO: 36819 - DNA, 127 bp, Homo sapiens
  misc_feature 31, 32: n = A,T,C or G
gagaccatcagggctgaaaggtgcacacagnnagaagggagctccatgaagtacagactcatgggcagagtttgagtgaaggtagtcggtagtctggtctagaaatcggtgaattagctggcttggg

SEQ ID NO: 36820 - DNA, 461 bp, Homo sapiens
actgacagaacctggaggctattaaatacaaaatggcagttttctttcaaagtgaaaatatttgcttctttgatactcctcagtgccttgcagtctcccaatcacagaagagtagatatgggaagggccaagaggagtatgttgccagtggccctacaagtccatgtgtgctgaagtccctatagcaaccaccttactcttcagcccagtagctgcctcccatgtgaccattcacccgattggcaccattgctggagctactgtcacagggactttttgtgcaggtggtcacatcttcttcctctgagctgctctccacatcactgcgatcatccttcgatacctgggtgggatgagaccaaagacagaaaagtgaggaaagaactgtaagacacctaagctcagagacccaggtgtgggcacctgtgttcccagtctggtctgctttctgatgacatcta

SEQ ID NO: 36821 - DNA, 299 bp, Homo sapiens
  misc_feature 159, 257: n = A,T,C or G
atcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcngccccagctaaggttgaagccaaggaagagtcggaggagtcggacgaggatatgggatttggtctctttgactaatcaccaaaaagcaaccaacttanccagttttatttgcaaaacaaggaaataaaggcttacttctt

SEQ ID NO: 36822 - DNA, 199 bp, Homo sapiens
  misc_feature 24, 199: n = A,T,C or G
gtgcccagggctgcatctgcaaangggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgactcan

SEQ ID NO: 36823 - DNA, 351 bp, Homo sapiens
atcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaacttgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgc

SEQ ID NO: 36824 - DNA, 487 bp, Homo sapiens
tatggccggggaaagtctacgtgtaattcatcttcgttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctatcggtacaacatataaatgaaagtacacctacactaatagtctgtctcaacaatgtgtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaatatcatgtttttatataaat

SEQ ID NO: 36825 - DNA, 330 bp, Homo sapiens
  misc_feature 311: n = A,T,C or G
gaattaaacgtagttcagcttgcaaggtgcgacctttttacctctggcaggcagagacaggcaagagcaagaactaggaatagaagaattgcagaagaggcttcaaggccaggctgggcacagtggctctcacctgtaattccagcactttgggaggccgaggcaggcggatcactttgtggtcaggagtttgtcaagaccagcctggccaacatggtgaaaccttgtctctacttcaaagaaaaaaaaaattagctggacgtgatggtgggtgcttgtaatcccagctagtcgggaggctgaggcagganaatcacttgaacccgggag

SEQ ID NO: 36826 - DNA, 482 bp, Homo sapiens
  misc_feature 459: n = A,T,C or G
agatcccccacaccaaaaagagaattgtgagatataccagttattaataccagttattaaatcaacaactgggccaggcatggtgtctcatgcctgtaatcccagcactttgggaggccgaggtgggcagatcacaaggtcaggagatcaagaccatcctggccaacatggtgaaaccccgcctctactaaaaatacaaaaattagctgggcgtggtggcgtgtgcctgtaatctcagctactagggaggctgatgcaagagaatcacttgaacccagggggcaggaggttgcagtgagccaagatcgtgccactgcaatccagtctagtgacagagctagacactggctcaaagaaaaaaacaaaattaacaactgtatagaaccaactggtgctaaagcaacatagagaccagaatttaatttaggccatctgttgttatttggttggtgctggtgnttaaaggcatgtgaagaacagct

SEQ ID NO: 36827 - DNA, 142 bp, Homo sapiens
  misc_feature 15, 77, 142: n = A,T,C or G
cgaaccttgctacanaaaatcagtatttaagagtatccctggagaaggaagaaaaagccttatcctcattacaggangagttaaacaaactaagagaacagattagaatattgggaagataaagggacaagtactgaattan

SEQ ID NO: 36828 - DNA, 475 bp, Homo sapiens
  misc_feature 7: n = A,T,C or G
aatgggngactttaacaccccactgtcaacattagacggatcaacaagacagaaagttaacaaggatatcgaggaattgaactcagctctgcaccaagcggacctaatagacatctacagaactctccaccccaaatcaacagaatatacattttttttcagcaccacactacacctattccaaaattgaccacatagttggaagtaaagcactcctccgcaaatgtaaaagaacagaaattataacaaactgtctctcagaccacagtgcaatcaaactagaactcaggattaagaaactcattcaaaaccacttaactacatggaaactgaacaacctgctcctgaatgactactaggtacataacgaaatgaaggcagaaataaagatgttctttgaaaccaacgataacaaagacacaacataccacaatcctgggacacatccaaagcagtgtgtagagggaaatttata

SEQ ID NO: 36829 - DNA, 471 bp, Homo sapiens
  misc_feature 13, 23: n = A,T,C or G
gggttcaaacttntataactttngaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaagg

SEQ ID NO: 36830 - DNA, 336 bp, Homo sapiens
  misc_feature 34: n = A,T,C or G
tggggtcgacagtattcactgaaagaaggggacngtgtaccagacaaagagaaatgacatgttgaaagttcctgaggagacaaagacgtggatgaactgtaaggagacatcccaactgaagcttggggagctaaggaggcagtggggctcaagagattagcaagaactagaatatgatggattgctatgcaggcattcaagccagatttccagagatttgggtgatttattaaaatgctaattccataaattaggaaaaagcatggagtgaagccttgtgtaaacatcttgactattttcagttgcagggactcacgcaaggtggattgtaatagc

SEQ ID NO: 36831 - DNA, 266 bp, Homo sapiens
  misc_feature 34: n = A,T,C or G
gcttctcacagtaaattctgctggatgtcacagntgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggaga

SEQ ID NO: 36832 - DNA, 464 bp, Homo sapiens
  misc_feature 7: n = A,T,C or G
atgtccnggtggccccagcctacattcttcagcatttgaattctgtcaagttgactgcaacctctctctttttctctctggctccccaccccctccttcccttggctctctgcttctccctccccacccttggtgcagaggaggctggcagcttgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacct

SEQ ID NO: 36833 - DNA, 487 bp, Homo sapiens
gggaaactcagagccgggttcctcccgggtttctgccgggtttctccctgcggctcctgggttgttgagactcttgtgaagatggctcgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaagggacacaaaaaacaggaggtgctgaccaaagtcttcaacaaggagagggaagt

SEQ ID NO: 36834 - DNA, 383 bp, Homo sapiens
gtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgccgacttgtctttgcaatatttcttttctgatttatttaattttcttgtatttatatgttaaaatcaaaaatgttaaaatcaatgaaataaatttgca

SEQ ID NO: 36835 - DNA, 462 bp, Homo sapiens
  misc_feature 6: n = A,T,C or G
gacttngtcacagcccaagatagttaagtgggatcgaggcatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattg

SEQ ID NO: 36836 - DNA, 232 bp, Homo sapiens
  misc_feature 219: n = A,T,C or G
tatggccgggagagacagacattatcatgatttaaaagattcagtattgttaagatgttggtttctcctgaaatcgagtctgtcagttcagggcaatttcagtcaaaatcccaacaagctttttaacagaaattggcaaactgattacaaactttgtttggaaatgtagacctaaaatagccaaaataattttgaaaagccaaatttggatgacttgcnctgcctgattcca

SEQ ID NO: 36837 - DNA, 475 bp, Homo sapiens
  misc_feature 31, 150: n = A,T,C or G
tgcttcaaaaccttgaaaatggcccatggcnttgtccatctaacagagtccagtaaaatcctgacaatggaatggggagagagaaagtgagaaccaccaaactcagcacaaaacgactgagtttaaacctctgtgctaagagatgatcangagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatggtgtgtatctcctagggacttcaatgtatctttgcccaggatctgaaaggcaatacttttgaggtgtagttctcaggaaggactgagcctctgtcttccagtctctgtgggaggttagaat

SEQ ID NO: 36838 - DNA, 490 bp, Homo sapiens
  misc_feature 32: n = A,T,C or G
ggggacccgatggattgtagggagtagggtanaatacagtctggtctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagtccttcatttattgcagatttttctttatatcattcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtcca

SEQ ID NO: 36839 - DNA, 475 bp, Homo sapiens
  misc_feature 219, 312, 382, 421, 472: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaagcttcttcatggagtaaaaaatgtatttaaaagaaaatngagagaaaggactacagagccccgaattaataccaatagaagggcaatgcttttagattaaaatgaaggngacttaaacagcttaaagtttagtttaaaagttgtaggngattaaaataattttgaaggcgatcttttaaaaagagattaaaccgaaggngat

SEQ ID NO: 36840 - DNA, 445 bp, Homo sapiens
  misc_feature 18, 32, 441, 443, 444: n = A,T,C or G
tatggccgggcaaacaancatgggagaacagnaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatccgtgtgtcaattaaaaatttttaattaaaaaattntnnc

SEQ ID NO: 36841 - DNA, 265 bp, Homo sapiens
  misc_feature 34: n = A,T,C or G
ggaacatcggatgaagctggaaaccatcattctnagcaaacttgctctcactcgtatgtgggagttgaacaatgagaacacatggacacagggaggggagcatcacacaccagggcctgtcagtgggctgggggctatgggagggatagcattaggaggaatacctaatgtagatgacggtttggtgggtgcagggaaccaccacggcacgcgtgtgcctatgtaacaaacctgcatgttctgtgttctgcacatatatcccaga

SEQ ID NO: 36842 - DNA, 165 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatag

SEQ ID NO: 36843 - DNA, 375 bp, Homo sapiens
  misc_feature 365: n = A,T,C or G
tatggccggggaggatccagtttcattctcccgcatgtggcttgccaattatcccagcaccatttgttgaatagggtttaccttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccaaatttgttgtttttgcttagttttgttttggctgtgccggttcttgtttggtccatataaatttcaggattgttttttctagttctgtgaagaaggatggnggtattttga

SEQ ID NO: 36844 - DNA, 199 bp, Homo sapiens
cacttagcaggcaaagaacaattttttattatcaaaaaggtttctgcacattgttgtggcaatattgtatctgtttagaaaatgggcttttccaaaagcaaacaaagataggttcctcaggcgaccaaaactgaaaatcaatatttccatgtttcattaatcaaggcataaaatacaattaaagcaaaatattttacag

SEQ ID NO: 36845 - DNA, 469 bp, Homo sapiens
  misc_feature 7: n = A,T,C or G
ggcgcantagatatagtaccgcaagggaaagatgaaaaattataaccaagcataatatagcaaggactaacccctataccttctgcataatgaattaactagaaataactttgcaaggagagccaaagctgagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccgccaattaagaaagcgttcaagctcaacacccactacctaaaaaat

SEQ ID NO: 36846 - DNA, 462 bp, Homo sapiens
  misc_feature 7: n = A,T,C or G
ggaaaanctgatttttgtgaacgttgctgcttgtgcccgaactaactctcaggcacattagtcagaaaatattacgtttggttgctcccccaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttaacacagtggatctctgtgccacatgggaggccatg

SEQ ID NO: 36847 - DNA, 219 bp, Homo sapiens
  misc_feature 1, 4, 204, 205: n = A,T,C or G
natntacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagnngcggggggcctagc

SEQ ID NO: 36848 - DNA, 298 bp, Homo sapiens
  misc_feature 7: n = A,T,C or G
acagatnttagaattatctgaaaaagattttgaagtagtcatcataaaaatgcttcaatgtatataacgtgttcaaatacaaacatacttggaacaaatgaaaaaatggaaagtctggaaaatataatgtctcaacagatcgatacataaagaagaaccaaatggaaattttaggaataaaaaatacaatgattgaaatttaaaactcaatgaataagctcagcaacagaatggagaggacagaggaaagaatgagtttgaagacagaaaactacaaattatccaatctgaacactag

SEQ ID NO: 36849 - DNA, 438 bp, Homo sapiens
  misc_feature 32: n = A,T,C or G
ctaaagcagaaactgaagcaatcgaacaactnaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcattttttttgtagagggtgatatatac

SEQ ID NO: 36850 - DNA, 463 bp, Homo sapiens
  misc_feature 7: n = A,T,C or G
ggtgganctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggcttgctgctaaggcacctacaaaggcagcacctaagcaaaagattgtgaagcctgtgaaagtttca

SEQ ID NO: 36851 - DNA, 442 bp, Homo sapiens
  misc_feature 6, 8, 25, 32, 33: n = A,T,C or G
agcctncnatagattatattccagnaaaaatnngtaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaaggtatgatctatacttttcaatatagttatctcagaaaagtcaaggagttatgatctttaattacgatcgagaaacttaaatatacattactctgcttaacagagaagccaacctactctggacttttttttggtggggtagtttaactgagggaaatgtatgataaatgtggattttaagtattattgtaatgtattaccttcattgtggattgagttccagtaaattgaagataaaggatagtggaatg

SEQ ID NO: 36852 - DNA, 481 bp, Homo sapiens
  misc_feature 42: n = A,T,C or G
tatggccgggggggagctctaactagctgtgtacatttcttngtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccat

SEQ ID NO: 36853 - DNA, 242 bp, Homo sapiens
  misc_feature 35: n = A,T,C or G
caagaacagggttcttttaacatggattccatgcngtgaatgaagacataggtttcttacccaacacaaatggacagtggatttgactttctaaagacttttttgtggacattttgacatttggagaagaaagatggcacactaacccagataatagtttttatgcctggaattttttgcagtttgatttgtatacgtatgacctcttgaaatgttaatttttaataaaatttgtaacactt

SEQ ID NO: 36854 - DNA, 305 bp, Homo sapiens
caggaccttcgagagcacttgagtaacaacagctaccgccccactcaacagcagatgactgaaagttcttcctgtgaggtcaggaacaaggcaagtgtgcccttgcctgccctctacttatgtgcttttataaatgggattattttcttaatttccttttatactgttcattctgatagtatagggaacaactactaatttttgcatgtaattttatatccagatattttgctgaattcctttttcagaagaggaaatgccacttctactcatcatagtagtagaagccctagacagagaaatta

SEQ ID NO: 36855 - DNA, 185 bp, Homo sapiens
cactttccctgaagagaagttctctttatgaattaagagtacaaaatcctctgagatgaagcaacctatccagttctatggaatgaatggagaatctttcagaaagaccatcattgggtagggcaaactgttttttttcctttcccccaaaagagtatgaaaaataaatgtcttgtttattatcg

SEQ ID NO: 36856 - DNA, 245 bp, Homo sapiens
  misc_feature 6, 103, 106, 109, 139, 169, 222: n = A,T,C or G
gaggcnctgaggcagccagcgcaggggcttctgctgagggggcaggcggagcttgaggaaaccgcagataagtttttttctctttgaaagatagagattaatncanctncttaaaaaatatagtcaataggttactaanatattgcttagcgttaagtttttaacgtanctttaatagcttaagattttaagagaaaatatgaagacttagaagagtaccgngaggaaggaaaagataaaaggtt

SEQ ID NO: 36857 - DNA, 300 bp, Homo sapiens
atggccgggcgcaatactgtaggaacaagcatgatcttgttactgtgatattttaaatatccgcagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 36858 - DNA, 233 bp, Homo sapiens
  misc_feature 6, 32: n = A,T,C or G
ctgaantttaaaattagatattaaagctgtcntatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaac

SEQ ID NO: 36859 - DNA, 154 bp, Homo sapiens
  misc_feature 18, 25, 45, 122: n = A,T,C or G
aaggcagagaggaacaangcgaagnccacagtatggtactcaagnaggatgctgctaaatgaatgcattagagcgaatctcacatttcttttttattcactcagcttcttttcagattattngtttatcttaatgctggttaaattattttgag

SEQ ID NO: 36860 - DNA, 120 bp, Homo sapiens
  misc_feature 32: n = A,T,C or G
tcagcccatatagttggaattgaaaaatgaanaagctgctagaaacctttgagggcatggcttccgtgtgaggcaggaatggcagtcacaattaagggaagtaaggaatgtggttgaacg

SEQ ID NO: 36861 - DNA, 177 bp, Homo sapiens
atactcattgaagacaaagttaggaaacatagataaacgtaaaatttaaagtcatctggggctggacacagtggctcacgcctgtaatcccaacacgttggaggctgaggcaagaggatcatgtgaacccagaggtctgagaccagcctgggcaatatggtgaaaccccatctctac

SEQ ID NO: 36862 - DNA, 474 bp, Homo sapiens
ggggcggaaaaagcaaagtggatgagtttccgctttgtggcccatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgatttgaggccctgcgcagggccaagttcaagtttcctggccgccagaagatccacatctcaaagaagtggggcttcaccaagttcaatgctgatgaattttgaagacattggtgggcttgaaaagcggctcatcccagat

SEQ ID NO: 36863 - DNA, 402 bp, Homo sapiens
ggattaagacctaaatgtgaaatcctaaactataaagtcttcagaatataatataggaaaatatctttggacttcagaataggtaaatattttaaaacaaaaatagaaaaacattaaattggccaggcatggtggctcatgcctgtaataccaacactttgggaggcccaggtaggcggatcacttgaggtcaggagttgagaccagcctggccaacatagtgaaaccccgtttctagtaaaaatacaaaaaattagccaagtgtggtggcaggtgcctgtaatctcagctacttgggaggctgaggcaggagaatcacttgaacctgggaggcggagtttgcagtgagccgacaacaggccactgcactccagcctgggtgataaagtgagactctgtctc

SEQ ID NO: 36864 - DNA, 108 bp, Homo sapiens
  misc_feature 24: n = A,T,C or G
ggggaatcagggttcgattccggngaggagcctgagaaacggctaccacatccaaggaaggcagcaggcgcgcaaattacccactcccgacccggggaggtagtgacc

SEQ ID NO: 36865 - DNA, 465 bp, Homo sapiens
tagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggc

SEQ ID NO: 36866 - DNA, 170 bp, Homo sapiens
aagaaatcttcctaaattattcaatagcagaattctctgccatgataaaggggagtcaagcacttctatacctgagctgtcatattatttgtatcacttgtaaagtaatgaaaacttaggtacactataggcatctctttacatggttctgtaattattaacctcaactt

SEQ ID NO: 36867 - DNA, 473 bp, Homo sapiens
atttcagaattatctaggttaaatattgatgtattatgatggtcgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagtattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacagaaaaattgtcttccatgaaactggtcccaaaaagggtggggaccacaggtttaaagcatggccacattt

SEQ ID NO: 36868 - DNA, 331 bp, Homo sapiens
tgtaagctatggatgttgcacaggactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttga

SEQ ID NO: 36869 - DNA, 463 bp, Homo sapiens
  misc_feature 19: n = A,T,C or G
agttgaagtaaatccaaanatgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggac

SEQ ID NO: 36870 - DNA, 466 bp, Homo sapiens
caatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaac

SEQ ID NO: 36871 - DNA, 307 bp, Homo sapiens
  misc_feature 5, 13, 45, 49, 53, 54, 139, 140, 180, 213, 225, 229: n = A,T,C or G
atagnggtagggntcaataaattgattccagacagcgttggaaangacntagnnaaggcttgcactatgctatttattcctctccatgatgtcttcgttagaaaagtaaaaatgctgaagaagcccaagtttgaattgnnaaagctcatggagcttcatggcgaaggcagtagttctggnaaagccactggggacgagacaggtgctacaagntgaacgagctgntggntatgaaccaccagtccaagaatctgtttaaagttcagacttcaaatagtggcaaataaaaagtgctatttgcgtggga

SEQ ID NO: 36872 - DNA, 316 bp, Homo sapiens
gggggtggcaatcaccaaaacaattaccagccatactaaaggagaacattggagaaaacaggaggagatgttaaagtaacccatcttgcaggacgacattgaagattggtcttctgttgatctaagatgattattttgtagaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgca

SEQ ID NO: 36873 - DNA, 159 bp, Homo sapiens
ggaattaaggtagtataaatctgaagtagactctgataagttaatgtgtatttaacacttcctagaacaaacactaaagaaataactgcaaaaatattgtaaggaatcattaaataaataaaatattacattacaaaatatgcacttaagacaaaagtg

SEQ ID NO: 36874 - DNA, 473 bp, Homo sapiens
atagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcat

SEQ ID NO: 36875 - DNA, 328 bp, Homo sapiens
gtttggcggcatcccaccgcccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcg

SEQ ID NO: 36876 - DNA, 137 bp, Homo sapiens
aggaggctggggcaagaggattgcttgagcctggtcagggaggcagaggttgcagtgagccctgatcgtgccactacactctagcctgggcaacaggatgagaccctgtctcaaaaaaaaaagaaaattgacgccgg

SEQ ID NO: 36877 - DNA, 295 bp, Homo sapiens
agcaaagccaattttggaaccttagtctcttgactctcagtctagtgctccaactactgtactgtgaccctctaattgaatctatgacggcacctgtgtcaggggtacaagatgaggctcatggaaatttatccaaatgaatagctgttttaaaatcatcattaaaactgtccatgggccaggcgcagtagctcacacctgtaatcgcagcactttgggaggccaaggtgggcagatttcctaagcccaggagttcaagaccatcatgggcaacatggtgaaacactgtctctac

SEQ ID NO: 36878 - DNA, 465 bp, Homo sapiens
ggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaagaatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggatagaaggctcttagattatattgggcagcttgcaatct

SEQ ID NO: 36879 - DNA, 450 bp, Homo sapiens
gggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttacct

SEQ ID NO: 36880 - DNA, 211 bp, Homo sapiens
aaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgcc

SEQ ID NO: 36881 - DNA, 465 bp, Homo sapiens
gaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 36882 - DNA, 476 bp, Homo sapiens
aataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaggcaccaggaagtgtttatgaggaaacaacacccaagatgaattatttttgagactgtcaggaagtaaaataaataggagcttaagaaagaacattttgcctgattgagaagcacaactgaaaccagtagccgctgggtgttaatggtagcattcttcttttggcaatacatttgatttgttcatgaatatattaat

SEQ ID NO: 36883 - DNA, 466 bp, Homo sapiens
cactgaaggtatattgaaacttaatatttgctattccgtctgatcctttagagcaggaactggattttacttgtttattttttaatctcttgtaaaggacagcctatgaaaatgtaagggatgttcactgaactgattaactgatgaatttttttgtaagacgacaaagtgaaaggagcccagttctccaaagagaggtccttgtagaaacattggtcactaccatctggagggcataatcattcctgaaagaatgtgggaagtggtatttgttctgtccattgaaaaacaaatgttaaaaaataaattttagaaattttcctttcactcttactgtgactgctatattgaaatgtattttttctaatgattaattgaatcattagggagaaaaccctcttattttacagtattgatataaaatgatctcaaggtcattgatatgaagtgaccaccaatgtaaata

SEQ ID NO: 36884 - DNA, 100 bp, Homo sapiens
aatcttaaaactgggcaactttggaagaacttttaacagaagcctcaatgatgatcactttgaattgcttgtgatttcaaaaataaagcagtgaagcatt

SEQ ID NO: 36885 - DNA, 273 bp, Homo sapiens
cgcggtggctcacgcctgtagtcccagcactttaggaggctgaggcgggtggatcaggaagtcaggagatggagaccatcctggctaacacagagaaaccccgtctctactaaatatacaaaaaattagccgggtatggtggcgggcgcccgtagtcccagctactccagaggctaaggaaggagaatggcgtgaacctggaggcagagcttgcagcgagccaagatcgcgccactgcactccagcctgggcaacagagcgagactctgtctc

SEQ ID NO: 36886 - DNA, 185 bp, Homo sapiens
aaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 36887 - DNA, 465 bp, Homo sapiens
attcacagttgttattgtttacagaccatttaattaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcatattttccaaatcttaatttggatttaaggaagaaatca

SEQ ID NO: 36888 - DNA, 477 bp, Homo sapiens
aatacaactacttaaaaaatatagtcataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtg

SEQ ID NO: 36889 - DNA, 369 bp, Homo sapiens
ggaacataaaaattagagcagcaaaccgtgacaaggtcagggtggggtagttggcagttttcccccaaggaggtatttgttaatttctgagaaaccctgaattagaggtaactgaaggtaagcgatacatacactacatttgtaagtagtttgaaaaacaaagggatagagagggtagctatatggaaaggtggagagaacttttgttgtttgggaagcatttatatatccatgagatttggagagaagactagggattttctcacatgaagttttacatgtgagaagagagaattatggtggcaaggtcctgaagaggactgatgactaaatccccacctgaaataggacgaagaaaatgaggacagc

SEQ ID NO: 36890 - DNA, 461 bp, Homo sapiens
atgtaaatccaaaacatggtcccataaaaacccaaccaaaagatctaacctaaagcaaaaaatgataaagaaaaaattacctaatgaaagtaaaacaacatgaaagaatcattaagaggtccctttattcaactgtatcttcataaatttgaaaactaatatgaataattttctaagacaatgtaatttactaagactagctctggtagaaacagaaaatcttagaacatggattttcttagaagaaacagagaaatttgcaaagcagctagattcccaaagcagcaagtccaggtgttttcacagttgtgtcaaacaactaaaaggtcttaaaaagaaatcagatggttttaatgcttttaaatcctcttcttgaacattgaaagagacagcaaactttcaaagttttactatgaaggaagtatattatttacagcaaaagtaataacaatgacacacac

SEQ ID NO: 36891 - DNA, 466 bp, Homo sapiens
  misc_feature 46, 70: n = A,T,C or G
caccagatttagagaatcagcatcaccttagtcttagtatttgccntttcattttcttcttaatgtaggntttctgataagcaatgtggactacgggcctggcaggcagaagatcgaagttcttctagtcaggctttgccaccagacagctgcatgacttaggcagtcttctttatttctctaggtctcagcttcattttctataaaaggaggatactgtactagatcatgattctactgctaataataatgctatttgttgagtcctgctatattccaagcactccccaactacatttatcttcagagcaagtctctgaagtgttctgttatgagctccatctttatagatgaggaaactgagtctcaggaaagttaagtagcttactcaactcacttaacaatgagtggtacagctttgatctaacccaaaattgtctgccaggctgaactgttacctgaggca

SEQ ID NO: 36892 - DNA, 342 bp, Homo sapiens
gctttccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttg

SEQ ID NO: 36893 - DNA, 226 bp, Homo sapiens
gggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttccc

SEQ ID NO: 36894 - DNA, 340 bp, Homo sapiens
ccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaggcaaggcttacagaaggatgttccttcaggaggaagcagcactaaaagcactctgagtcaagatgagtgggaaaccatctcaataaacacattttggat

SEQ ID NO: 36895 - DNA, 450 bp, Homo sapiens
gatgatgagctttttttctgttttttggctgcataaatgtcttcttttgagaaatatctgttcatgtcatttgctcactttttgatggcgttgtttgtttttttaactgtaaatttgtttaagtttcttgtagattctagatattagacttgtttgtcaaatgggtagcttacaaaagttttctcccatcctgtacattgcctgttcactcttatgatagttgctttcgctgtgccgaagatctgttgttcagttagattccatttgacaattttggcttttgtcgccattgcttttggtgtttcagacatgaggtctttgcccgtgcctatgtcctgaatggtatgtgccaaattttctttatccagtctatcattgatgggcccttgggttggttccaagtatttgctattgtaaacagtgccacaataaacatacatgtgcatgcga

SEQ ID NO: 36896 - DNA, 430 bp, Homo sapiens
gctcttccggggacgttgtctgcgggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatggaaaagacgcc

SEQ ID NO: 36897 - DNA, 237 bp, Homo sapiens
tctaaataccacgatcaaaagggacaagcatcaagcacgcaacaatgcagctcaaaacgcttagcctagccacacccccacgggaaacagcagtgattaacctttagcaataaacgaaagtttaactaagctatactaaccccagggttggtcaatttcgtaccagccaccgcggtcacacgattaacccaagtcaatagaagccggcgtaaagagtgttttagatcaccccctccc

SEQ ID NO: 36898 - DNA, 357 bp, Homo sapiens
gttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatat

SEQ ID NO: 36899 - DNA, 115 bp, Homo sapiens
  misc_feature 115: n = A,T,C or G
aatcctatctagtttcaatcttaaattgtttgcctataccaatctagtttattgtttgcctatattttatagtgtagagattaggcattttaataaaattttaaaatttccaggn

SEQ ID NO: 36900 - DNA, 422 bp, Homo sapiens
atatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaact

SEQ ID NO: 36901 - DNA, 316 bp, Homo sapiens
gagagttagcccaagtataggctctgcccagatgccatcacatccctgatactgtgtatgctttgaagcaccttccctgagaagggaagaggggatctttggactaggttcttggctccagaccaggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattac

SEQ ID NO: 36902 - DNA, 466 bp, Homo sapiens
atatggcacagagttaggcccttcagggttgaagtctgtggtttcttgtgtctcaagactcaatgtcttgagaagttggtggaccctgtcctccatccaagaagtgctgccaaggaaaccaggggacctagcaaagagtcaggagaaaatggccaaaggaattctgacattccatacctgaatgaactgttttcgtgagtgctttgatcaccctatcccctatcaaggcgctgaacaggtggcccgcaggaaatctgctgtcgcaagaggagggctttgacttacttcccctaattgttgagtaaaaagtgattctcttaatttctgtattctgtttttcatatcaccagtagaagggtcctgtggatctaaatagagcacattttaaggctacagagtagtagaaattgatgtttagacaaggcagcttgttcaaaatctgaaaggcacacccagaagctttctc

SEQ ID NO: 36903 - DNA, 211 bp, Homo sapiens
gggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcc

SEQ ID NO: 36904 - DNA, 490 bp, Homo sapiens
caggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagag

SEQ ID NO: 36905 - DNA, 159 bp, Homo sapiens
agaaaaggcgtgtagtactaagggaacaatccatgtgattaatgttttcattatgttcatgtaagaagccccttatttttagccataattttgcatactgaaaatccaataatcagaaaagtaattttgtcacattatttattaaaaatgttctcaaat

SEQ ID NO: 36906 - DNA, 466 bp, Homo sapiens
  misc_feature 189: n = A,T,C or G
aacaaatgtgaataataattatagtaacaatccagaagatactatctttaacacagcctttttataggtctttaacacaggctttttgttttaggaaattcatatttttgttaattgtataaatatttttaatatagataagtataatgtgataaataaaagattttcaggcataaaaatgtgtcactngtaggacaaggtttcttaaccttatcaatagcactattgacattttgagtcagataattcttgttcttgggggctatcttcagctttgtaggatgtttaatagcatctgtggttcactggatgccagtagcacccttccttaagttgtgacaatcaaaaatgtctccagacattgtcaaatgtcccctgataggtaaaatccccaccactacctctagtgactccacccctgttgagaattaactgttctaggataagaatggaatgaaactataac

SEQ ID NO: 36907 - DNA, 465 bp, Homo sapiens
acaaagggcccttcctgcagcagctgaaggtgttttctgatgaagtacagcagcaggcccagctctcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaaggaaagtgttttttgctaccgtgaaacct

SEQ ID NO: 36908 - DNA, 443 bp, Homo sapiens
ctgatgcaaaccatacattgaaagctattttaagaagaagtcactctaataagctttaatttcgagtttatgaatcacaggatttttggtagaggtaaaaactatacttacaccgtaaattagacattaaatgccatttaatcagtcagataatgattaatgttagagtaatgtttgatgggccaagctgctaaaacataagcagttctaattaaaatatataaacttatcacgtaaaaatagcaaacttagtaatgtataaagtgacagtaggtcttttttgcttaaaaatcagagttcctgtgtagtgtctctttatgatctctgtagtaaaaatattatttaacgtagcttagtggagaagtttaagaggagtataccttttactttagggtgcccatgccactttgaagttatggagtgcaaagtagtttccacacatt

SEQ ID NO: 36909 - DNA, 470 bp, Homo sapiens
  misc_feature 187, 188: n = A,T,C or G
cacacaatccttcctcattatggcatttagcttttcatattttttgtgtcttattctaaagaggaactcttaattatgacatttatttgaattatttgtggggagaagagaaagaggaaacacttattatttattcaaaagggaagctaatgcatgtgcaattattaattcagagaatttggcctgnntatattcaagtattcagcatcagcttaccaaagtaaattgagttatcttttcttcaactgagataaattttcaaaatctgtgaaatttatgaaacaatacattctgatattaagaaacaaacatctttggtgtcatgctgtgaaatttgtacatgttaaatagcatctactgctgactcttaaaagttctgtgtacttttttctccctctcagatgagtacctctactctggaacagcttctgatttccttggcaaagatactgcattcactcgatcccttg

SEQ ID NO: 36910 - DNA, 466 bp, Homo sapiens
ggttgaacaaacacatctgaagtgtagttgaggggcatgttttaaagaatggactccgcaattcatcgtgatggtttaggtgtgtacacacgcttgaaactttctgaggaaagttcttgaatagtaccttccttttggagttagaatttgaagtttaacatgcataactttgaaaatttagagcatgttgtaggagacgttcctcagaaattaatgacaaagttataatggttttaaaaacttgaatgacaagtgatgagaatatatataacttgcatgatttgggggtaccgctaagagtaattaaaatacctcattctatttctagcgctgctattagtagcttagtgatctgaggcaaattacttgacctctgtggactctatttcttacctgtaaaatgaacgatttagagatgacttaaagatttctccaaactgtaaaaaacgaattgctttctttttat

SEQ ID NO: 36911 - DNA, 457 bp, Homo sapiens
gaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagtaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaag

SEQ ID NO: 36912 - DNA, 466 bp, Homo sapiens
  misc_feature 27: n = A,T,C or G
ggagtctctttgcggcgctacactagnagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccggttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttat

SEQ ID NO: 36913 - DNA, 102 bp, Homo sapiens
  misc_feature 63, 84: n = A,T,C or G
gggggaaaaatgcctgaaaattagggggcacttcaagtaggatagcttctatttcctatattncgcgcttatatacaagtattngctttgtatcaaaataat

SEQ ID NO: 36914 - DNA, 471 bp, Homo sapiens
ggaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcgacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataac

SEQ ID NO: 36915 - DNA, 245 bp, Homo sapiens
gaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaac

SEQ ID NO: 36916 - DNA, 176 bp, Homo sapiens
ggaccagcagaggcagagcccacctctggcttagaatcactgacatttagactccaggcttcaacctgtttacaagcggactttccaaaggaagggggtgggagatagggccatacaaaacaccagccgccgtcccccaaaacaaaaagtgcctttcggcagccttcaaatcggca

SEQ ID NO: 36917 - DNA, 477 bp, Homo sapiens
caagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaact

SEQ ID NO: 36918 - DNA, 460 bp, Homo sapiens
ggggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggat

SEQ ID NO: 36919 - DNA, 463 bp, Homo sapiens
  misc_feature 21: n = A,T,C or G
gaggtgtgaggctgtcacagnattggtgatctgctatctctttgagatcaactaatttggagaagtgtgtgtgtgcgtatccttttttaagtcaaagtttacaaccttactgcaggtgtatgaggcagacagttctgtttatagactacctccttcctggaaaagtctcagtttcatattctgttgaatatatgcagaattcttagagtgaaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggg

SEQ ID NO: 36920 - DNA, 120 bp, Homo sapiens
ggagggctgagcaagagctgggatgcttagttctaatgtggggttggaccagaatcacatctacataggtcatagacctgaattccagtgaaaaccaataaagaaatgggaattttgttt

SEQ ID NO: 36921 - DNA, 463 bp, Homo sapiens
aaggaatataagtcattctgttataaagacacattcacgtgtatgttcactgcaacacattcacaacggcaaagacacgtaatcaacctaaatgctcatcaatggaagactggataaagaaaatgtgatacgtatacaccaaggaattctatgcagtgagactaagtcctttgcagggacattattcttggcaaactaagtcaggaacagaaaaccaaatgccacgtgttctcacttacaagttggagctaaatgatgaaaacacacgaacacataaaggggagccacacacactgggtttttcggaaggtagaaggtgggaagagggagaggatcaggaaaaataactaatgggtactaggcttaataccttgggtgttaagggtaggctattgggtgataaaataagctgtacaacaagcccccatgacacagctttatctatgtaacaaacctgcacatg

SEQ ID NO: 36922 - DNA, 466 bp, Homo sapiens
attcctgatgaatataaatgcaaaataattgaacaaattgtaggaaaccaatttcaacagcacatcaaaaaaaaatacaccatgattaagtgggacttattccagggatactaggatggttcaacatacacaaatgaataaatgtgatacattacatgaaaataatgatgtacaaaggccatatatttatctcagtagatgcagaaatcacatcctataaaattcaacatcttcttatgataaaaactctcaacgaattaggcatagaagaataatgcctcaacataataaaggccatatatgacaaacccacaagtaacatcctactgaatgaggaaaaggtgaaagaactttctctaagagctaggacaacacaaggatgccctctttcaccactcttattcatcataatactgaaagtccttgtaacagaaatcagacgaagaaaaaaatatatctgcattgg

SEQ ID NO: 36923 - DNA, 357 bp, Homo sapiens
ggttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagagatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcct

SEQ ID NO: 36924 - DNA, 437 bp, Homo sapiens
aagaaatctgttgttacaaagtctagggtgggagagaataattacacatagctttttgataaacaatctaaattgtgcttcaaaggacagatgtggctttaataatctgaagcatttgcattttcagattaaactttgcttgattgcgttgtacttgatatgtatacttaaatctatatgttaaatgttatactttgatatagcacatcttgtttgactttgttcctatgatctgacaagcttcattatataataacctagtttaaataaatcttaaagacataaaagtgttcctgacagtaagaaaaaatttaaggcacacaaatgatgtatcggttagatgttccagagagagtcgaagttttttcattcaaatctttgaacatgtgttttgaataaagctgtaaggcattttccagtaaccagtgttgtattac

SEQ ID NO: 36925 - DNA, 491 bp, Homo sapiens
aaggaagtcctctctggaacctgctgattttcaggatggaaacccatcctgtcggggatgcattccacagcctctcccggcctccagggaggaagaagtccctactcccagcccaaaaacccggtaccctgctgcccgattcactcagcaaatgctttcagagaactcactttgtgccaggccctgagaggaacgaagagatgctgcccttcactatttagggtctgcaacctcctgggggctcctgggaccctttcaaggggtctacaaagttaacactatttttataacaacacgaacatgtgattcgccttctctcacatgcatacagtgggggttttcccggaggttacatgatatgtgatattgcaacagactacacgcacaagcaggtatgagtttctgttaagcctggcatgaaagagatgggcaaaaatataaaaacaatgccactcttttcacagtatttttttgttttaaaaaaataggtt

SEQ ID NO: 36926 - DNA, 460 bp, Homo sapiens
  misc_feature 460: n = A,T,C or G
gaactcggtggtggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggagggaaaggaaagaacttgcatgttggtgaaggaagaagtggggggggaan

SEQ ID NO: 36927 - DNA, 235 bp, Homo sapiens
ggtagagatgcggtttcgccttgttggtcaggctggtctcggactcatgacctcaggtgatctgtctgcctcggcctcccaagtgctgggattacaggtatgagccaccacacctggcctgactggctttttttatgccaaataatattccatcatatggattggatataccatgtatccattttagtagttgatggatatttgggttgtttttactttttggctattattaata

SEQ ID NO: 36928 - DNA, 285 bp, Homo sapiens
atcaattctccttctagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttct

SEQ ID NO: 36929 - DNA, 478 bp, Homo sapiens
tacgttagataaatttggaaaacatcctatatgatatccctttcttgggcatttacagtgcatatcatatcgtgtgtatttgtgtgtgtgtttatgtctgtgagactgtgtgtgctcgcatgtgcatggctgtgtgcatgtgcagagtacctgctaagtaacacttcttgatgtcctaagggacataataggaaatgctaggttaggggatgcactaaaagtataaggagtagcaattactggtggaaggctagaaagcgtttattaaacaacattttagaagttagtattgcttatgttttgatatcacagatgatgaggaaattactatcctatataattaaattttttccatcattgaaatgtcaagagtgaatatcaaaaaaagtagatgccatttcctttatataatgaactctggatcatttaagggcttattcacaaatttttgactatctgatggagagattatatttgg

SEQ ID NO: 36930 - DNA, 478 bp, Homo sapiens
  misc_feature 11: n = A,T,C or G
attcttagttnttctttattataataattattattaattagtgttcagaaacctcaggaagaataattctcttaactggtttctaagttgttgagatatgtgtggatctgaatgatttggaaagtaagtaagtggactagcaaactgtaagcatcatataaatatgctttattaaggaatgtggttacacctcaaattactcttttacttaagaaaataagaatttaaaccacttgacataaactgcaggaaattgttgaatgatttatcttaatttaatttctttaaattctttcctgtgatgtgctaatatgtatgtaattaagaaccaaatgagaaatgtactcttgaaaaaaactttaagttttgaaaaccttataaaaatataaaaagtcatttttcccctatgattaaagaaaatcaagttaatgcatgacctatatgttgctccttgacagtctttaatagacaaaatact

SEQ ID NO: 36931 - DNA, 125 bp, Homo sapiens
atcgaagaattacaaaaaacaatagcctcatcatccccaccatcatagccaccatcaccctccttaacctctacttctacctacgcctaatctactccacctcaatcacactactccccatatct

SEQ ID NO: 36932 - DNA, 258 bp, Homo sapiens
  misc_feature 2, 16, 53, 59, 67, 70: n = A,T,C or G
cncccccggggaaccnccggccccctccggcccggggtagaaactggttgtanttagangttctctntcntttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattag

SEQ ID NO: 36933 - DNA, 284 bp, Homo sapiens
gaagaatgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaaga

SEQ ID NO: 36934 - DNA, 103 bp, Homo sapiens
  misc_feature 6: n = A,T,C or G
tgagtntccttcactgcccagacagcatacccagattctggggaggcgggattgaatgagtcacagctctgacttgagaaacttagagagtgagtcagacaag

SEQ ID NO: 36935 - DNA, 463 bp, Homo sapiens
  misc_feature 12, 43: n = A,T,C or G
aaactggaaganggagccagatggtgctttttacccagatganatacaaaggcccctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgccccgatgtgcagcgagcagttccctcctgactatgaccagcaggtgtttgaaaggcatgtgcggacccattttgatcagaatgttctaaattttgactagttacttttattatgagta

SEQ ID NO: 36936 - DNA, 411 bp, Homo sapiens
  misc_feature 7, 409: n = A,T,C or G
ctgtttnaaacccttgtgtgctggtttacaaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatattgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgttcaataaatattgtacttattngg

SEQ ID NO: 36937 - DNA, 464 bp, Homo sapiens
aagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttg

SEQ ID NO: 36938 - DNA, 169 bp, Homo sapiens
  misc_feature 5, 6, 117, 147: n = A,T,C or G
aggtnnttttagtttctgttctgtggaaagtgtaaagcattccaacaaagggttttaatgtagatttttttttttgcaccccatgctgttgattgctaaatgtaacagtctgatcgngacgctgaataaatgtcttttttttaatgngctgggtaaagttagtctactc

SEQ ID NO: 36939 - DNA, 495 bp, Homo sapiens
  misc_feature 3, 23, 30, 33, 38, 39, 45, 46, 47, 55: n = A,T,C or G
ctncgggccgggggttgtcctgncttttcntcntgaanntctgannntgagggangggctgggatcgcttatttactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctatactaccgagatgcccgttcttacaaccggtttcaaatcgccactgtcaccg

SEQ ID NO: 36940 - DNA, 420 bp, Homo sapiens
  misc_feature 5: n = A,T,C or G
aaccnaagctaatatagcaaggactaacccctataccttctgcataatgaattaactagaaataactttgcaaggagagccaaagctaagacccccgaaaccagacgaagctacctaagaacagctaaaagagcacacccgtctatgtagcaaaatagtgggaagatttataggtagaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacccg

SEQ ID NO: 36941 - DNA, 131 bp, Homo sapiens
  misc_feature 6, 17: n = A,T,C or G
agcccnaatattctacnaatcaaccgacaagtcattatttaccctcactgtcaacccaacacaggcatgctcataaggaaaggttaaaaaaagtaaaaggaactcggcaaatcttaccccgcctgtttacc

SEQ ID NO: 36942 - DNA, 492 bp, Homo sapiens
  misc_feature 5, 14, 24, 27: n = A,T,C or G
gaacntttgttgantccctgtcantcngtttctcctcttccctgctgtggtcctctttccagtgatggaaaagttttagtcttgtgaaaaatgacccctcaggatgccaaagtttcaagctattttgtgagagctccgagtatagatgatagagacttttatgtaaagatgggaatttacaaggcaatattttaataaaagggaaagttagagggtatcttttcaataaaaaattttaaatatcattcaggcatgttggctgtctagcacatattacagtcctctgtcggtagactaagctctttgagggagggatgatattttatttttcttagtagaattaaagtcaatctttagcagattgactgacacatggtaggtcaaagtaactacagtattttattgaacttaattgttgactcccctctgtgtatcccatgaacttcttgggtctcttgttcttcagaaagaaaggtagaatacctcactgat

SEQ ID NO: 36943 - DNA, 314 bp, Homo sapiens
  misc_feature 6, 10, 309, 314: n = A,T,C or G
tgtccnaganaagcctctgttgggttgtgttgggaagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttnaacan

SEQ ID NO: 36944 - DNA, 316 bp, Homo sapiens
  misc_feature 9, 26: n = A,T,C or G
gattttctnccccgggaatttcggcntttttggccgggcgtggtggctcatgcttttaatcccagcactttgggaggccgaaacaggcggatcacgaggtcaggagatcaagaccatcctggctaacatgctaaaaaaccccgttctctactaaaaaatacaaaaaattagccaggcgtggtggcaggagcctgtagtcccagctactccggaagctaaggcaggagaagggcatgaacccaggaggcagagcccgcagtgagccgagatcgcaccactgcactccagcctgggccacagagcaagactccgtctc

SEQ ID NO: 36945 - DNA, 500 bp, Homo sapiens
  misc_feature 11, 13: n = A,T,C or G
tctctgagccntnatggaccgggggcccctgtctggaatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattcccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatacttttgctggaaaactttcttatgtgaaaacttgccaagagaaattcaaga

SEQ ID NO: 36946 - DNA, 485 bp, Homo sapiens
atctcaggaccctgtaataattgcattaactgcacaaattatacagcatgtgtgtttgagcagtatgaaatgtgggcaccttgaaaaaaagaacaggataacagcaatgtttaggcagcaagagagataaccttaaactctgactgccggtgagccgggtggaacagagccatatttctcttctttcaaaagcaaatgggagaaatatcgctgaattctttttctcagcatggaacatccctgagaaagagaatgcgcacctgggggtgggtctctgaactggccccccgggtgtggtcgtctcttatggtcaagactgcaggggtgaaatagactccagtctcccatagcgctcccaggctcattaggaagaggaaattcccgcctaataaattttggtcagagaccagttgatctcaaaaccctgtctcctgataagatgttatcaagtgacaatggtgccccgaaacttcattagcaatttt

SEQ ID NO: 36947 - DNA, 491 bp, Homo sapiens
tatggccggggaacatatattttgtattcccagcctttctttcttcgggagccattcttttcccattcttcagtgatcctgctctgtgcctcagacttggctgaaggtaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgtttgggttttctgacttacaattgaaagagttctgtccaaaaagccaaaaggtggccaggcttggtggctcaggcctgtaatcccagcactttggga

SEQ ID NO: 36948 - DNA, 196 bp, Homo sapiens
  misc_feature 2, 22, 27, 33, 45, 50, 78, 79, 81: n = A,T,C or G
tnggcccgggggcccggaagcnagtantgtgantgaccgtaaganagtanttgcgcccgttggtgattaccggaaganncnaggagtttggcgtgacccatggggaaagcaaaagaaaacaaggaagtatgcgacccatgaagcgaatgcttagtctcagagatcagaggcttaaagaaaaggatagattaaaacc

SEQ ID NO: 36949 - DNA, 332 bp, Homo sapiens
  misc_feature 7, 14, 31, 39, 67: n = A,T,C or G
cgggaanctcggcnattatggcccggggaangatgtccnaaattctgaagccctgtattggctttcntccgtatgattttgtagctctcaagcaactacaagacacgccaagcaagattagtgaagacaataaagatgaacaaataggcggttttcttactgaacagctcaataaagtctcactctttttctccaggctggagtgcagtggcacaatctcagctcactgccacctccccctcccaggttcaagtgattctcctgcctcagcctcctgagtagctgggattacaggctagttttgtctgatgaggaagcaagctttgagagtg

SEQ ID NO: 36950 - DNA, 343 bp, Homo sapiens
  misc_feature 11, 24, 25, 32, 33, 73, 96, 99: n = A,T,C or G
ccggcggtgancgacctacgccanncgagaanntgccctctcgcaaaggatctccttcatcccctctccagangaggagaagaggaaacacaaganganacgcctggtgcagagccccaattcctacttcatggatgtgaaatgcccaggatgttataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 36951 - DNA, 496 bp, Homo sapiens
  misc_feature 13, 16, 34, 39, 51, 52, 58, 78: n = A,T,C or G
cgggaggagggangangtgattgcttcccaagantaacncctacaatttannttagangcttttacgagtgtatttanttgaaatttttttaatgatcactggggaaaattgattaatacatcagaaaatttccccttctaaaattatcatggccatgtgcaatcatctaaaatagaaggtggtaaaatgtttggtctcagaatttttcttctgggtgctatcttgagcttgcataaaaatatttctgaccccgcttccacagaacatatatggcccatgctttagttgtgcaccttaacttttaaaatatgacaaattcatcttctgatctgttgattgtcaaaaatatatggagttggagatgggcaaactttattcttaaggcaccaattagtatatgtttttaagatttcataagggtactcaactctgcagttacagcatgaaagcagctgtagaaaatacacaaacaaatgtgtgtggccatgttccaac

SEQ ID NO: 36952 - DNA, 500 bp, Homo sapiens
  misc_feature 4, 8, 32, 77, 497, 498: n = A,T,C or G
aacnactntggccggaacctcctcgctctccntctgcagagttcccttacccctaagagaatgttacccacctgaanagtcctcggtgaatctgagaggagaggatggggtaaggcagaagcacccagctgtacctactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagcctgtagagcttgcaacttaatagcagcagctgcccaatgccatgtgaagtaacaaactggtttttggggttttttttttttccccttcagtttaatggtatgggggaaagggnntt

SEQ ID NO: 36953 - DNA, 129 bp, Homo sapiens
  misc_feature 14, 22, 44, 63, 72, 99, 100, 110, 120, 122: n = A,T,C or G
ctttggttttccanctcttganactgacctggttttttcggacnagtttactttgttggagangtgtgaccnaaaaagttccctgtttgccccttttcnnagttgaaaanaaaagtgtantntttttct

SEQ ID NO: 36954 - DNA, 373 bp, Homo sapiens
  misc_feature 1, 12, 39, 68, 108: n = A,T,C or G
ngcccggggaancaaatccgggggcaaggccaaaaagangacgtggtccaaaggcaaagttcgggacnaagctcaataacttagtcttgtttgacaaagctaccctantgataaactctgtaaggaagttcccaactattaaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtgggagatgctccagctgccggtgaagatgcatgaataggtccaaccagctgtacatttggaaaaataaaactttatttaaagc

SEQ ID NO: 36955 - DNA, 500 bp, Homo sapiens
  misc_feature 6, 7, 42, 60, 75, 409: n = A,T,C or G
tcggcnntttatggcccgggcaccctgagctaaaggaaaaantaatgcaaaattaattcntgataaaattgaacnaatggtcctaagatctccaccaacaggagaatccattttacggtatgctttgcccattccatcgagtaagacaaagaacttactaccagaagatgaaatgatcggaaaaattatcaaacatctgaagatgggttgtttccactttggaagaaacctatggacattgcgatcagaatgggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggnttcagtggcaggtcaatcagatggaagaaggataaagaaaatcgaccagaagcagtgaaaagttgtgaagctctggcacagaaaattgaag

SEQ ID NO: 36956 - DNA, 135 bp, Homo sapiens
  misc_feature 47, 74: n = A,T,C or G
tggcccgggatctgtagaagttttgctttgttgatctgagccttctntgaaagtttaaatctgtaacgcattcntgaatttccagtgttcagtaaatagcagctatgtgtgtgcaaaataaaagaatgatttcag

SEQ ID NO: 36957 - DNA, 471 bp, Homo sapiens
gggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgtttgggttttactaaaaaacgcaacaatcagatac

SEQ ID NO: 36958 - DNA, 479 bp, Homo sapiens
gggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaggtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgt

SEQ ID NO: 36959 - DNA, 467 bp, Homo sapiens
  misc_feature 6, 7: n = A,T,C or G
tcggcnntttatggcccgggaggaggggtcacatccaggagggcttagtgggacactgaacaaagagtttgtctttaattgaaatggttttgggaagccatagggacatggagccaggagacagtacaatctgatttctgccgtttaaagttgtctctggcctcggtgcggataataaagaggataaaccataaagcagagaccagtttctggactcatgtggtcatctaggcaagagaaggtagtggcagtggagatgaacttggatggattcagaatgcgtttggagacggatatggtgggagagagaaaaagaagcctcaggcagggtcttaggtttcaggggttttggtgtcctataaggttaaaagcccggatattattctggggtttctatccttggtcctgagcctaacttacattactaaaaataagcagttgggataagaaacaacctaaaagtcagc

SEQ ID NO: 36960 - DNA, 480 bp, Homo sapiens
gttacacagtatgcgatttttgagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagct

SEQ ID NO: 36961 - DNA, 468 bp, Homo sapiens
actgcatgttgttggcaaatgattgagatgcatgtgcacaagacaagttgccaagagtcccagcagagatttcctgatacattgatgggagtttgggggtttcagcccagccaacataaaaagactttgctaaaagacttagatgttcagttgagactccataccctagagtaaggagcatgtgccaggactaagcttaaaattggaataaatctgccataacaaaaaataaaatcaaacctaatagaccaaaagtttctgccaataatttaattgcctttcagaagaaattcaacatcccttaaagaaagatcacataatccagactctccactacatatcattcacaatgataaaacaattactagacatgcaaagaaacacgaaatagtggcccacagtcaaaagaaatatcagtcattataaacaaatcctatgatgatctagatattttgaatttagtaggac

SEQ ID NO: 36962 - DNA, 235 bp, Homo sapiens
  misc_feature 28: n = A,T,C or G
tatggccggggaggcattgaggcagccnagcgcaggggtttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 36963 - DNA, 192 bp, Homo sapiens
  misc_feature 3, 7, 30, 31: n = A,T,C or G
aancttnttttggaaggcttgtctagagtnnagcatgtatttttaccctttgcagtgaattgcatgtgctaattgtaacccacagctattttttatgttgacataactccaaatgtcatattaaatgttctattatatattagctctaatcccttaagtaaattttaagaaataaatacttgttcaaatttt

SEQ ID NO: 36964 - DNA, 423 bp, Homo sapiens
  misc_feature 6, 362, 419: n = A,T,C or G
atagtnatgatccttcgagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttaganattgaagagatctttgtgccacacaggatttttttttttttttaaaaaaaacctttngatg

SEQ ID NO: 36965 - DNA, 369 bp, Homo sapiens
  misc_feature 15: n = A,T,C or G
agcttttgtattatnaacttttttagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 36966 - DNA, 499 bp, Homo sapiens
  misc_feature 7, 26, 38, 39, 42: n = A,T,C or G
tcggcantttattggcccggggtgcnagttctggaaanngtnagggtcagctgatctacgagtctgccatcacctgtgagtaccctggatgaagcatacccagggaagaagctgttgtcggatgacccctatgagaaagcttgccagaagatgatcttagagttgttttctaaggtgccatccttggtaggaagctttattagaagccaaaataaagaagactatgatggcctaaaagaagaatttcgcaaagaatttaccaagctagaggaggttctgactaataagaagacgaccttctttggtggcaattctatctctatgattgattacctcatctggccctggtttgaacggctggaagcaatgaagttaaatgagtggtgtagaccacactccaaaactgaaactgtggatggcagccatgaaggaagatcccacagtctcagccctgcttactagtgagaaagactggcaaggtttcctagagctctactta

SEQ ID NO: 36967 - DNA, 498 bp, Homo sapiens
  misc_feature 7, 8, 35, 62, 64: n = A,T,C or G
ctcggcnnttttggccgggcttccctgagtccctntaaatcggctttccttgtgatgtagantntctgattttcaatttttggaaaataaagctatttacaacaatactgagattgtttttgtctcaggcattatagactgtcagaatagaaagggccataagtaaatatagagtctaatctctctttctggttgggccagagacacagggcccagagtgatttgttggctttccctggtccagtatttgtaagtagtataatcagatttagagcccatgtatatgtgcactatttttttggctggagtaaggaagtagcaattatgaaaaactatcttcaatcaaggattacctggtaacagtgtctattttgtatgttaccggtaactatgagttctatctttactgggccaagttttccctagttactcagaagagaggcaaaccacacatcatcactatctggctgaaaatacttaggatatgcaaacagtact

SEQ ID NO: 36968 - DNA, 284 bp, Homo sapiens
  misc_feature 10, 42, 175: n = A,T,C or G
attgaagaanaaatgaaatcaggatcctgccttaaaaagaanaacttttgttaaagtatttccactgaaatcacagatattttgtgggtattataacaatcattggaaagcatggagagctacatttcataatttgagggaaaatttctaacagatgccagaatgcttgtttatngggattgctgtgtttccttttattatttgtggttccaaacaattattgtttgaacttttttaattctgtactaaaatctataataaagcttttccacagctttaaaact

SEQ ID NO: 36969 - DNA, 480 bp, Homo sapiens
  misc_feature 471, 476: n = A,T,C or G
agcaatggctttgattcagaccttaaaatccctaagaagaattacaacctgttatggatttttaagtggcaggtattgtaactgttttttgtgtgcaaaatactgagtaaccactgggaaaatatttcagatgaaagggatgacaaaagcctgttgcgctttgcatcagcaaggcattgacttctgaaaaaatgatctgaaaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaaagattgctctttttattaagtctttacagggatgtatttcattgnatggntttg

SEQ ID NO: 36970 - DNA, 382 bp, Homo sapiens
ggccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtactctggctcggataagagatgggacatcattcagtcactagttggatggcacaaggctcttcacagacgcatctgtagcagagtggaacttgtactaacttatgatagaatgtatcagaataaatgtttttaacagcg

SEQ ID NO: 36971 - DNA, 142 bp, Homo sapiens
gaagtttgtatattttccgtactgcagagcttacacaaaattgaagaatgttaatgttcgagttttcttatcttgtgtttagaggttgttttttgcagatcttggtgttaatagaccaaataaataaataaatattcccagc

SEQ ID NO: 36972 - DNA, 469 bp, Homo sapiens
  misc_feature 13: n = A,T,C or G
attgattcttgtnacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatctttgatggcaacaaaatcagcagagttgatgcagctagcctgaaaggactgaataatttggctaagttgggatttgagtttcaacagcatctctgctgttgacaatggctctct

SEQ ID NO: 36973 - DNA, 473 bp, Homo sapiens
gtcaacctttgtaagaaaaccaaaataaaaattgaaaaataaaaaccataaacatttgcaccacttgtggcttttgaatatcttccacagagggaagtttaaaacccaaacttccaaaggtttaagctacctcaaaacactttcccatgagtgtgatccacattgttaggtgctgacctagacagagatgaactgaggtccttgttttgttttgttcataatacaaaggtgctaattaataagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagc

SEQ ID NO: 36974 - DNA, 371 bp, Homo sapiens
aactagaattaactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 36975 - DNA, 472 bp, Homo sapiens
gcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacggagaagacttttcacaattattagacaaatcagaagatcagtgcaaagagccaaatagaagcactgtaggccg

SEQ ID NO: 36976 - DNA, 308 bp, Homo sapiens
agggagagtatacattagatgctcttccgaatgtacagcaaaagaacagagatgaagattgatagatgagagaaaatgatacctatgaaagaaaaaaatagagatttaactggtgactaatagatgtctgcaaaggagacaacagaagtggaacaaaagcatggatcaaatgtctcattgtggaagactttccagggttgaaaatgacctgaagaataaaagagctcactgtattctaaagaacattatgaaaacgtgtctgtacctagacatattttgctggttttcttttgattttaaggatcctg

SEQ ID NO: 36977 - DNA, 374 bp, Homo sapiens
  misc_feature 5, 10, 369: n = A,T,C or G
agtcnagaanccgcatccctcagcagggactgataagcccatctctcggagggccccctaataccccagtggagtctggttcacaccctggggggtgtgtcactgtgatgggacacgtaggagtccacccttaaaaccagcaccctgtccctcgaggctgccgagtgggcgtgtggacctggggtgccttcccacaaaactagcctccggctctgggcccgagacagccgcaggccccagccactgaatgatactggcagcggctggggttttatgaactcctttctggtatttttttcccctctatgtacaaatgtatatggttacgtctcaattttttgtgctttaagtaaaaataaaaacattttncaggc

SEQ ID NO: 36978 - DNA, 143 bp, Homo sapiens
  misc_feature 2, 30: n = A,T,C or G
antgttgaagttgtttatctccttaagaancttttgggaggctgaggcaggagaattgcttgaacctgggaggcggaggttgcagtgagccgagatcacgccattgcactccagcctgggcaacagaagtgagactctacctc

SEQ ID NO: 36979 - DNA, 249 bp, Homo sapiens
gggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatc

SEQ ID NO: 36980 - DNA, 472 bp, Homo sapiens
acgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtatttgaagtggctgagtggataccacgttgtgaggtcagccactgggtcacttgtagtcaatgcaaagcttgcac

SEQ ID NO: 36981 - DNA, 473 bp, Homo sapiens
atcccaaggtttgagacatcagcgctctggaaatgttgaagtcatggacgagagagaaaggaagctggggaaaatgagagtgtaggcagtgagctctttataggcccctttgcagagctggtctcagctcagcgttgcttcaggaacatggaaataaatgtgttacatggaactcggctggcttgctgatgggagttgcctgggacatttagagatgtgaaaactctggaaaaagaaaaaggaggaggaaattattttcatgcccatagtttttaggaaaatcaaatgtctttaggggaaaaaagagagagagggggagaaagaaaccccttttcctttggtggggaggagccttaaggctgtgttccgatcagccacgcacacatccgtgtcccctggccctaccctgggatgacagagccatcccttcacgttccaaggttgctcctgcctcaaatcccagattttccatg

SEQ ID NO: 36982 - DNA, 474 bp, Homo sapiens
attcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattaggtggttaccctattgaataggtcagaagtagaatcttttcatcatcacagaaagttctattggacagtgctcttctagatcatcataagactacagagcacttt

SEQ ID NO: 36983 - DNA, 337 bp, Homo sapiens
ctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaactcg

SEQ ID NO: 36984 - DNA, 468 bp, Homo sapiens
gtgcggggaggtaacaagaaataccgtgccctgaggttggacgtggggaatttctcctggggctcagagtgttgtactcgtaaaacaagggtcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttgggagttctatcttaaggaaaatca

SEQ ID NO: 36985 - DNA, 189 bp, Homo sapiens
cagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcgctcctatatttaattctcacaatcgtgtcgtcacatagtgc

SEQ ID NO: 36986 - DNA, 471 bp, Homo sapiens
accccagtagctgaagacaaaggccatattatcttgggagttctaaggcctcgcccacctcctgattctcctgattctcccctatactaccacagctaatggtctcttgaaatcctcacctcctggcaggaggccaaccagcacaaaccttgtgcatcaaacaactgcgactaagggcactcacagagtccatttcactctcccgccacctcactgccagtctcactggagactgagagaactgaagatggttcacatcaaagcactctgtgcagacagcccccagtaccagaccagaacctggtagccctgctgagtggctagatccagaagagaaataacattcattacagtttggctctcaggaagccacatccttaagaaaatcaggagagtactacatcaagggagcacccccgtggtacaaacaatgtgaactgcagccttcagcccgagatcttcgctctgaca

SEQ ID NO: 36987 - DNA, 256 bp, Homo sapiens
aacattgatgtcaagaaaatgacggtcacagaccaggtgaactgccccaagctctcgtaaccaggttctacagggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctgacctgctgtgctcgcagtagattcc

SEQ ID NO: 36988 - DNA, 469 bp, Homo sapiens
cattattgggtgttaaacgataggtagggtttatatatacactttagtgtgcatgatattgtggaacaaaacaattcacatggcagaaatgaaacaaatgaaaatgaacattttaagggtccaaaatcgaagtaagaaaataacagaataaacctaaaaaagtaaagaaagataatgaaaacaaacaaaaatgatagaaataatttaaaaagtcaaatgttaagtctttgtatagtcttcctgcaaacttaattttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatatttttt

SEQ ID NO: 36989 - DNA, 226 bp, Homo sapiens
ccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgag

SEQ ID NO: 36990 - DNA, 341 bp, Homo sapiens
aatcaagcccgaatgatatttcctattcgcctacacaattctccgatccgtccctaacaaactaggaggcgtccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccctttaccatcattggacaagtagcatccgtactatacttcacaacaatcctaatcctaataccaactatctccctaattgaaaacaaaatactcaaatgggcct

SEQ ID NO: 36991 - DNA, 159 bp, Homo sapiens
agaaaagctaagaattattttaaggtgtttactactagcatgtaaatgtatgatgggacagagatttccatcctattttgaggaattattttttatttttttgaaaacttaaggtaacaaagtagagaggaggccagggagaaaggaaggtagtggagc

SEQ ID NO: 36992 - DNA, 373 bp, Homo sapiens
  misc_feature 6, 17, 33, 72: n = A,T,C or G
aactangatctgacttntcttgccgtctttggnaactaaaagtagtgacttatacacatatgaggtgctcanaggcatttgactaatacagtcatgaatagagattgttacttagagtccttatattactaattattttgtaaactgaaatatatttttgtgaggaaaaactctcaatatatatcctggattttcattaatgtgcattttcttccactttcaagttaattctttttttttcctgattatttaacaaatacatgcctattaaagacaactttgggtagaccagaaggatgtaaagaaatccttccccatgaaggatatatattatgtaatgtataaaataggttatataaatatataggtatat

SEQ ID NO: 36993 - DNA, 465 bp, Homo sapiens
attcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctc

SEQ ID NO: 36994 - DNA, 431 bp, Homo sapiens
tcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaattt

SEQ ID NO: 36995 - DNA, 428 bp, Homo sapiens
  misc_feature 25: n = A,T,C or G
gtaacaaagtggaaagccttccagnatgaactctacttctgcaagaaacttaaaactctgaagattggaaaaaacagcctatctgtactttcaccgaaaattggaaatttgctatttctttcctacttagatgtaaaaggtaatcactttgaaatcctccctcctgaactgggtgactgtcgggctctgaagcgagctggtttagttgtagaagatgctctgtttgaaactctgccttctgacgtccgggagcaaatgaaaacagaataacttatttttcgttaaagtttgactgaaacacgcttctaccaaatacagtataaataattaggtagtcttaatgccttttcctatttttttttccttttcacacaaaatgtacacaaagatcgcgtaaggagtatgtatttttaataaaaatttaattg

SEQ ID NO: 36996 - DNA, 312 bp, Homo sapiens
  misc_feature 4: n = A,T,C or G
gacncgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggat

SEQ ID NO: 36997 - DNA, 296 bp, Homo sapiens
  misc_feature 6, 10, 26, 93, 237, 261, 264: n = A,T,C or G
ctggcntttnctggccgggcagtggnggctacacctgcaatcccagcactttgggaggctgaggcggatcacgaggtcaggagatcgagaccntcctggctaacatggtgaaaacccgtctctactaaaaatacaaaacattatgccaggcgtggtggcaggcgcctgtagtcccagtcccactgctgaggcaggagaatggcatgaatggcatgaacccgggaggcaaagcttgcngtgagccgagattgtgccactgcnctncagcctgggcaacagtgcaaggactccattcc

SEQ ID NO: 36998 - DNA, 472 bp, Homo sapiens
agaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttca

SEQ ID NO: 36999 - DNA, 474 bp, Homo sapiens
aggtaaacatatgtaacatccatccttgttgactttgaggtgagatcttagcattaaaatgaggtggaattgggctctttatgtgaaaaggtgaactgtgggacacagtttgtgcacagcctcagcgagctgctgaaactggctttaaggcctgcagttgcttgtcagaagaaaatgtttctaaggccagtcctctgcccagtcagagttgtcttggtctgggttgtaaatcagagttaggaggggtctgataggtcctgttcttagtgagtttagagccctagtaatttaaaaagttgctctattcccttaaccttaggatccatcttagttgataaagcagtgtctgttttggtctgtccgatcacatggtattatagtacccaaagactgaaaacaagataaatgaacatcagcatatactggtcaagttgtaggaaatatatacaatggaattttatgggagacaatgtg

SEQ ID NO: 37000 - DNA, 103 bp, Homo sapiens
  misc_feature 16, 21: n = A,T,C or G
gtagtcccagctattnaggangctgaggcaggagaattgcttgtgagtgagccgagattgcactactgcactccggccttggcgacagagcgagactccatct

SEQ ID NO: 37001 - DNA, 340 bp, Homo sapiens
aagggaggtgatgtggccagaggtgacgtggcaagggttatgggggtgacatggtgtggtggggggaggagatgtggccagaggtgatgtggccgggggaggagacatggctggagggaagcgacaagaggggtctccaggcctcagactgtggagctttcacgctcgcacaacctcacagactgtgcctgatttatggatgacattttaattaagatgttacatctaactttaaagaaaagtagttatttagaaccattgtgtatgtttaaagcacggtacaaatatagcacatttcccaaaccaaagaacagtgcattgcaggaaaaaatagcagctc

SEQ ID NO: 37002 - DNA, 146 bp, Homo sapiens
acaacaccaggacttaagacaaatgggactgatgtcctcttgagctcttcctttacttttgactgtgatttactttggagtggaggcattgtttttaagaaaaacatgtcatgtaggttgtctaaaaataaaatgcatttaaactc

SEQ ID NO: 37003 - DNA, 458 bp, Homo sapiens
  misc_feature 457: n = A,T,C or G
atttaagatggactgggaaaaacatcaactcctgaagttagaaattagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacng

SEQ ID NO: 37004 - DNA, 473 bp, Homo sapiens
agctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgcataaaatggaaatatcattattg

SEQ ID NO: 37005 - DNA, 229 bp, Homo sapiens
  misc_feature 18: n = A,T,C or G
aacgaatgggagtattanttgtgagaaatgcatcattaggttattttatcattgtgccaataccatagagtgtgcttccacaaacctagatggtatagcctactacacatctaggctatctggtagtctattgttcctaagctgaaaacctgtacagcatgttactgtactgagcactgtaggcagttgtcatacaatggtatttgtgtttctaaacatatctaaatat

SEQ ID NO: 37006 - DNA, 467 bp, Homo sapiens
ggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattattatcagtataaaaacactgagattgcttacctcccaaattgctttattgtattaactctcatgcttcagctcttggatttgttgtttctaactaacatgtcatgtacaccaaacattttataaatcaatcagtgaatattttgtaagacccaaaatcctggcatattgccaggtctgt

SEQ ID NO: 37007 - DNA, 411 bp, Homo sapiens
ggacaaaagggagttacagaggctgcttaaaagatggagaaaagcctgagattgaaggaggaaaaaaacccagtatttaaagtctctaaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcggtccaattcaccaggaaaacatgcttgtgaattgtgcagtaaaaggtggtaatgactactggaagctaagtcaaaggtgatttcctacctgattttacttacttaaataaaagttacttacaatgggga

SEQ ID NO: 37008 - DNA, 195 bp, Homo sapiens
  misc_feature 4: n = A,T,C or G
agangaaaacattaaattgtcttcctcgattctccatcgggtgtagagtttttaaactactcaatggcatttcaagtcttctgaaacggcatggctgtatgtgcgtggtccatagcacagtacatgcagcatctaataagagtttccattgtagaatgttttcacatacttgaataaatcaaatctttaattgag

SEQ ID NO: 37009 - DNA, 262 bp, Homo sapiens
  misc_feature 20, 117, 148, 204: n = A,T,C or G
agcaaaagttgaacaaagangaactaatgtattaccttacccttgccactgattttttttttaaatggtaaatgaccttgtatataaatattgccctatcatggtacctataatggngatatatttgtttctatgaaaaatgtattgngctttgatactaaaaatctgtaaaatgttagttttggtaattttttttctgctggnggatttacatattaaattttttctgctgggggataaacattaaaattaatcatgtttc

SEQ ID NO: 37010 - DNA, 472 bp, Homo sapiens
catgtttccttcttgttatttatgctattctctttgtggctccattcttctttaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttattttttaatgtcttgactcttcagagttcgtacctcaaaagaacagtgagaacatttgctttgctttctgctgaatccctaacctcaacaatctatacctggactgtccagttctcctcctgtgctatcttctcttct

SEQ ID NO: 37011 - DNA, 409 bp, Homo sapiens
agaatcccagaggacaaatttctgactttaagcaattattgaactatttggtaaatagaaatacagttgatccttgaaaaacacggggtcaggaatccaaggattaggggcagttgaaaatttgcgtataacttttaactcccccaaaactatactaatagcctcctgttgactgaagccttatcaataatgtaaacagtcaatgaacacatctttctatgttatgtatattatatattgtatactgtattaaagtaagctagagaaaatgttattaagaaaatcataagaggccaggtgcagtgacttattcctataatcccagcattgtggagggccaaggcaggaagatcacattaggccaggagttcaagaccagtctgggcaacatagtaagaccctgccctac

SEQ ID NO: 37012 - DNA, 123 bp, Homo sapiens
ggattaagaaaatgtggcacatatacaccatggaatactatgcagccttaaaaaatgatgagttcatatcctttgtagggacatggatgaaattggaaaccatcattctcagtaaactatcgg

SEQ ID NO: 37013 - DNA, 378 bp, Homo sapiens
gagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 37014 - DNA, 457 bp, Homo sapiens
gtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccgactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttgg

SEQ ID NO: 37015 - DNA, 341 bp, Homo sapiens
  misc_feature 254, 263: n = A,T,C or G
atgattagtaatgttgagcattttgttgttttggggagaaatgagcaggttaccttctattctgccatcttggtaacagcatttgtgcccattttccttttcatctgacctttcttttattgtttgcccacttttttttgctgattttttttttacgttatccttgtcttggatatttacatcaccactacagttttgtcagcgatacttttcatgtttgaatgtcattgacaccttctcccaacaaagtaggngtaacaggngtaacaggcaacagtagaagagctaaatagagatggagaaggcaaggaggaaaagaaatggaaaagaaaacacccctt

SEQ ID NO: 37016 - DNA, 469 bp, Homo sapiens
gaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggag

SEQ ID NO: 37017 - DNA, 278 bp, Homo sapiens
  misc_feature 2, 19, 28, 44: n = A,T,C or G
gntttttgcatcggggacnttacggctnatatagtggccggganatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatgctccagctttccccctcaaac

SEQ ID NO: 37018 - DNA, 339 bp, Homo sapiens
ccggcggtgacgacctacgcacacgagaacatgcctctcgcaaaggatctccttcatccctctccagaagaggagaagaggaaacacgagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 37019 - DNA, 303 bp, Homo sapiens
  misc_feature 15, 19: n = A,T,C or G
ggtcgtggaggaaancttngtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggc

SEQ ID NO: 37020 - DNA, 465 bp, Homo sapiens
  misc_feature 28: n = A,T,C or G
ggtgatagcggcagcgaggggctcgganaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggat

SEQ ID NO: 37021 - DNA, 218 bp, Homo sapiens
  misc_feature 20, 218: n = A,T,C or G
aaaacagtactacacaaatnatgcggaactcaagccatacatcacggaaggaagaataacggagaaggagataagagatcatatttcaaaagagactttgttctatatttgtggcccacctccaatgacagactttttctccaagcagctggaaaacaaccatgtacccaaagaacacatttgctttgagaagtggtggtaggaggcagacaaaggcn

SEQ ID NO: 37022 - DNA, 364 bp, Homo sapiens
ggctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgct

SEQ ID NO: 37023 - DNA, 155 bp, Homo sapiens
caaaggaaaatgcatacaacgagtctggttattcctagagaatcctaactgggagctgacaatattgatggggctcctgccaagtgccggggcctgtgctcatctctttatggactgtttcatccttacattggtattatcctcattttgcagtc

SEQ ID NO: 37024 - DNA, 462 bp, Homo sapiens
  misc_feature 444: n = A,T,C or G
tctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatnggggggtaccccaatctg

SEQ ID NO: 37025 - DNA, 429 bp, Homo sapiens
  misc_feature 427: n = A,T,C or G
cagaatatagaggaattgacccattttaaaattattttattttatatatatgtgtgtgtacatatatatgtatgtgtgtgtgtatatgtgtgtgtatgtgtgtacacatatatatatataggcagaggcagagtcttgccctgttgcccaaatgacacaatcttggctcattgtaacctctgcctcctgggttctatcgatcttcccacttcagcctcctgagtggcttggattacaggtgcacgccaccgtgtctggctgacttttaatgttttttatagagacggggtattgccatgttgcccaggctggtctcaaactcctcagctcaagtaatctgcccagcactttgggaggctgaggcaggcggatcacgaggtcaggagatagagaccatcctggctaacaaagtgaagccctgtctgtnct

SEQ ID NO: 37026 - DNA, 296 bp, Homo sapiens
  misc_feature 61: n = A,T,C or G
gggttttcggaactgaggccatgattaagagggacggccgggggcattcgtattgcgccgntagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtattggttgcaaagctg

SEQ ID NO: 37027 - DNA, 407 bp, Homo sapiens
agaagccccaggcttataatgacatcaggggcttgtgcccccattgacgttggacacctgacagattcaggtgcagagccagggtgactggcttctcagaggcccatggctacggtgcccccaccctgggcctgcagtttgctgtgagcctccactccgtagttgttcagggatccataactgtttttgttttgtttcagcctcttccatgagtggggagcccgctgcttgtctccagctcctagcagtgagtcctgataatctcaaatttaaggacagtaactttgtctgggatgagtgtgggaaaggatgtgtttgggaacagacgcgagcctgcagaggtgtttgtaaccatctctttctaagtggtgggaagcagacattttattctttaactgttaatatat

SEQ ID NO: 37028 - DNA, 331 bp, Homo sapiens
gacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattg

SEQ ID NO: 37029 - DNA, 193 bp, Homo sapiens
  misc_feature 190: n = A,T,C or G
ggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtaaaaaaaaaaaaaaaanccc

SEQ ID NO: 37030 - DNA, 332 bp, Homo sapiens
ggaagagaccggggttgagcgtctagcccatctctgcgtgacttccgccagcgtttagagcgttttcggggtccgagttgaagagcaaaaccaagtgaaggaaacttcactaagttcagggtgacaagggaggaagtacagagactgcactttaaattccggatgacagacctatcaggactgagtggacctttgagtgacaagatgggggtgttccaaagagaccatggcagcctgcagctaggactttaatacctattagagtgctaaggagaagacaagttattagcacccaaaagaagcaccagtgtggatggaaatacaaggttagc

SEQ ID NO: 37031 - DNA, 463 bp, Homo sapiens
  misc_feature 23, 149: n = A,T,C or G
aaatacagagaatgccacaaagnacactccttgagaagagcaactccaagacacataatcgtcagactcaccaaagttgaaatgaaggaaaaaatattaagagcagccagagagaaaggttgggttacccacaaggggaagtgcatcangactaacagctgatctctcggcagaaactacaagccagaagagagtgggggccaatattcaacattcttaaagaaaagaattttcaacacagaatttcatatccagctaaactaaacttcataagtggaggagaaataaaatcctttacagacaagcaaaggctgagagattttgtcaccaccaggtctgccctaaaagagctcctgaaggaagcactaaacatggaaaggaacaagcggtatcagccactgcaaaaacatgccaaattgtaaagaccatcgaggctagcaagaaactgcatcaaataacgagc

SEQ ID NO: 37032 - DNA, 147 bp, Homo sapiens
agtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccc

SEQ ID NO: 37033 - DNA, 468 bp, Homo sapiens
catttgaagtctgagagtttctaggtgagaggaaacgaacctggttactagatttagtgagcaaggctcacaaaagagagaaaggaagacaaaggctagggatccccaaaaagtgggatgtcatgagaattggaaccaagtggcaccccaagagaactagctttcagtggcatgtttctgatggtgacaggcctggtttgtaaaacctctaacatggtcctggactttccctaatctgttaacccagaaacagcatttttctcctagcataaggcagattctttcctgagctgcagcaagacctctacaatttcaaactacagccacgagataatcaacttgttggtgtcactctgtaagagtctgagcagtagtttttattttgtgagtcagttccagagacaggttttggtaagttgaggaggcaataattatgccagctattcctatagtggcacctgagatgcc

SEQ ID NO: 37034 - DNA, 468 bp, Homo sapiens
gttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaatt

SEQ ID NO: 37035 - DNA, 468 bp, Homo sapiens
  misc_feature 16: n = A,T,C or G
gcattttctaaaaaancgggagcagagctctctcttcgccgccgacgcagaaaggagctggggaggaaaaagctgctgccttttgcgctggagattcgtgggcaaggcttctcattttcccaggctgcttccccacccgggtgaggagcgtcctgagactaaggaaagagcctggaaaatggaacagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggagga

SEQ ID NO: 37036 - DNA, 484 bp, Homo sapiens
  misc_feature 311, 338, 361, 363, 364, 365, 366, 368, 369, 370, 371, 372,373, 374, 375, 376, 377, 378, 379, 380, 404, 405, 411, 412,413, 414, 415, 416, 422, 423, 424, 426, 428, 429, 430, 431,432, 433, 441, 445, 449, 450, 451, 461, 463, 469, 472, 473: n = A,T,C or G
aaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccccaggggattctcctccttcatcctgtaaaggtcaacaataaaaaccaaattatggggctgcttttgtcacactagcatagagaatgtgttgaaatttaactttgtaagcttgtatgtggntgttgatcttttttttccttacagacncccataataaaatatcctttccnannnnannnnnnnnnnnnnaaaaaccctttggggggccccccnncccccnnnnnntttttnnntngnnnnnnttttttcngggngccnnntttggggccncnttgccnttnnccccttggggg

SEQ ID NO: 37037 - DNA, 476 bp, Homo sapiens
gtctctactaaaaatacaaaaaattggccaggtgtggtggctgatgcctgtaatctcagctgtttgggagggtgaggcaggagaatcacttgaacccaggaggtggaggttttagtgagctgagattgcaccactgcactccagcctgggcaacaagagcaaaactctgtctcagaataaataaataaataaagtattacaccattccacctttccacttattagtcatttgagcataggttcttactgttctaaaagtgtttaaacacttactgtggaaatgcaatgttggaaagagcacaagactacacaacacatagcttctgtgacctagctttggtttaatagtagctactgatatggtttggctttgtctccacccaaatcttatcttgaactgtggctcccataattcccatgtattgtgggagggacctggtgggaggtaattgaatcatgggggcagtttcccccat

SEQ ID NO: 37038 - DNA, 476 bp, Homo sapiens
  misc_feature 23: n = A,T,C or G
attgaatgtgaatggccctcagnaaaatctctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatga

SEQ ID NO: 37039 - DNA, 466 bp, Homo sapiens
  misc_feature 448: n = A,T,C or G
gggtctcaccatgttgcccaggctggtctcaaacccccagcctcaactgatcctcgcatctcagcctcctgagtggctgggatgacaggcgtgcacctggcggctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctctgcctgtgggaaggcaaatgatgcctcagagctctaaccaaaggttttgcagccgccgaaaaacaggaaagtcgggaagcggggggtaggactacactgaatcattaacagtgctgtaaactaccatgtggccattaacaatgacctttangggagttttcctaaacga

SEQ ID NO: 37040 - DNA, 466 bp, Homo sapiens
gataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttg

SEQ ID NO: 37041 - DNA, 466 bp, Homo sapiens
cagcttaaagaacttcggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagacatcaaaaaggaatgttaccatccctcatgctaatccttttcattttaaataaacaggatctaaaaaaaataatgctgggaagtcctaaccacatcaagaatgcctcagatcagtgacccaaggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttca

SEQ ID NO: 37042 - DNA, 440 bp, Homo sapiens
gctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggcccaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtgggatgagaactaatcgctgatcgtcagatcaaataaagttataaaattgc

SEQ ID NO: 37043 - DNA, 473 bp, Homo sapiens
atctaaccatagtgcttctctgcaaatgaaatctccgcctcacagccccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgct

SEQ ID NO: 37044 - DNA, 339 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggac

SEQ ID NO: 37045 - DNA, 130 bp, Homo sapiens
aagagaatgctggctattaaaagatgcaagcattttgaactgggaggagataagaagagaaagggccaagtgatccggttctaagtgtcatcttttattatgaagacaataaaatcttgagtttatgttc

SEQ ID NO: 37046 - DNA, 122 bp, Homo sapiens
ataagtgaagattttattttaaaaaccgtgggaaagagtggggggtttctttttatgtctgggtcattcaggcagtacatctgaattaagctgaatgtagacaaataaagaaaaacaagact

SEQ ID NO: 37047 - DNA, 465 bp, Homo sapiens
gaggctgaggcaggagaatcccttgaacccggagggcagaggttgcagtgagctgagattgtgccattgcactccagcctgggcaacatgagcgaaactccatctcaaaaaaacaaaaacaaaaaataaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcggcccctag

SEQ ID NO: 37048 - DNA, 212 bp, Homo sapiens
attttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgttt

SEQ ID NO: 37049 - DNA, 307 bp, Homo sapiens
gaatatgtagtatattcaatttaaaaactttctggccggagcagtggctcacgcgtgtaatcccagtactttgggaggctgaggcaggtggatcacctgaggtgaggagttcaacaccagcctggccaacatgatgaagccacatctctattaaaaatacaaaaattagctgggtgtcatggcactcacctgtagtcccatctactcaggaggctgaggcaggagaatcgcttgaacctggggaacagaggttgcagtgagccgagatggcgccactacactctagccggggcgacagagactccat

SEQ ID NO: 37050 - DNA, 300 bp, Homo sapiens
actccgcaccatctagaggaaagtctagaaaggtttaaaatggtattttacaagttcactatatcagtttatttatctatttatttagagacagagtctcactctgccgcccaggctggagtgcagtggtgtgatctgggctcactgcaacctctgcctcctgggttcaagcgattctcctgcttcagctactcgggaggttgaggcaggagaatggcatggacccgggaggcagagcttgcagtgaaccgagattatgccactgtggtccagcctgggtgacagaacgagactccatct

SEQ ID NO: 37051 - DNA, 472 bp, Homo sapiens
tgtcaacatatgataaagagacttgaacgatttttttgtgtggacatatgattagattttaacaggccttaatattcatatatttaaggaaaacatatgacttcaatgtgaacatgtctatacttgattttaatgaataatttccacaacagttaatcgtttttgctaacatgaaatttgaggatccttaaaggagaaccttgaggttatcaaagtaggtttaatatttttaaagtataccttcatttttaaatatgcatctttttactccagtatatttcaaaaaatgtgttttaatacacacacttaaatgaatgatatggatagtatagccatatacaaatttatactgtttccaacaaagacttctctagtaagatttaatatgttactgatacttcatatgcctttattgatgtttaaactagtcctgttattctatctagcttgatccttcacatttcccatctct

SEQ ID NO: 37052 - DNA, 262 bp, Homo sapiens
agtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttct

SEQ ID NO: 37053 - DNA, 471 bp, Homo sapiens
  misc_feature 55, 463: n = A,T,C or G
atttccaaaatgtggtgttaatttttctacttgcagtcttaggactagatacatnctaggtgactctgctactttattctttacacgtatgttttctacatgtggctgtgtgcatcataatgagtatatgtgctcatattttacagaatgtttttcgctttcaattttattttaccagaatttgtggaatgccctgtgtggtatattattataagctttttagtcataaaatctccagagaaagaagagagctgcaaaattcatagccatcatggaaatctcttggaagatacattttccttaactttaagcagccaggcgtggtggctcacgcctgtaatcccagcactttaggaggccgagtcgggtggatcacctgaggtcaggagttcgagagcagcctgaccaacatggtgaaaccccatctctactaaaaatacaaaaaaattatttgggaagtggnggcaggtg

SEQ ID NO: 37054 - DNA, 469 bp, Homo sapiens
ggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtcta

SEQ ID NO: 37055 - DNA, 473 bp, Homo sapiens
ctggtaaaaggaattaaaaatgcaaatgttaccacgtccctgtgtttggaagaacaggatcttcaaatgactttaaaacattctaggaaggcacactttaatatgcatacaaaaaggagaaacttttcattaaaggaaggtacaaagaataatgctacactgacaagatgttgtaaatggattaacatacgactcaggttgagacattttttaagtgctttgtcttcaggaagcagatagaaaaatacaaataatgctgagaaaacagaagcaaggaaaaccagagagaaaacacaggatcttatggaggtggttcacatctaaggaacttggatagaagagcaagaaccattggattagaagtaactttctttattattttcttcatgttagaaggatggaaactttaagggaaggaaaatatatgtaaggactctgaaaggcaatttttaatttttgaaaagtcaaaggca

SEQ ID NO: 37056 - DNA, 150 bp, Homo sapiens
atagcctctgtctaaattattggtcagctgttcaagtatgcaacacaaatatgacctcaatggaattgaaaaaaaaaatctgaacagagacatcagtgggtacagaccatggggaatgagattctacagtttatattcaggtaagttacc

SEQ ID NO: 37057 - DNA, 470 bp, Homo sapiens
ggcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaac

SEQ ID NO: 37058 - DNA, 343 bp, Homo sapiens
attgcccctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaac

SEQ ID NO: 37059 - DNA, 425 bp, Homo sapiens
  misc_feature 25, 129, 384: n = A,T,C or G
gaattacctggatgttctttttacnaggtgacaagagttggggacagaactcccattacaactgaccaagtttctcttctagatgattttttgaaagttaacattaatgcctgctttttggaaagtcangaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtnccaaaattttaaaaaagggagtttttgatagttgtgtgtat

SEQ ID NO: 37060 - DNA, 270 bp, Homo sapiens
aactgcccttccgtccccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtg

SEQ ID NO: 37061 - DNA, 131 bp, Homo sapiens
tcggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 37062 - DNA, 358 bp, Homo sapiens
  misc_feature 33: n = A,T,C or G
gaagtcccctttggaaacttctgcaggggaaangagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaattttaaaga

SEQ ID NO: 37063 - DNA, 308 bp, Homo sapiens
  misc_feature 32: n = A,T,C or G
atgacccgctttaaaaacatttctgtctgctnaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataat

SEQ ID NO: 37064 - DNA, 455 bp, Homo sapiens
cagggcctatgaatatttacgactaagttttaagaattttatagttatatctcctacatttaggtctttgatccattttgagttaattttcatatatgatatgaaagagagatctgacttcgttcttctaacgtggctattcaattgtcagagcaccatttatggaaaggatttttttcccattgtcaaaaatcaactatagaggtatgggtttatttatagattcttaattgtattctaatgatctataatatcttcttatgccagtaccacattgccttgatttctgttgctttgtaggaaattttgaaagcgagagtcctaagtttgttttttctaggttgttttggttattctaggtcccttgtatttccatatgaattgcaggatcagcttgtcaatttctatactaaaataaaggcagttgggattttcataagcgttgtattcatgac

SEQ ID NO: 37065 - DNA, 225 bp, Homo sapiens
  misc_feature 32, 224: n = A,T,C or G
agcggccggctttcccgaggggccactgtccntgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgng

SEQ ID NO: 37066 - DNA, 226 bp, Homo sapiens
gaggccctgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgagg

SEQ ID NO: 37067 - DNA, 208 bp, Homo sapiens
  misc_feature 7, 35, 105, 112, 150: n = A,T,C or G
gatctcnccctatcctttacggcaagggtaccttnggtacctgaaaacaacgatggcatggaaaacacttcccatttacctgttgttgctgctgtctgttttcgngattcancaagtttcatctcaagagctttcctgtaaaggccgctnctttgagtccttcgagagagggagggagtgtgactgcgacgcccaatgtaagaagtat

SEQ ID NO: 37068 - DNA, 341 bp, Homo sapiens
  misc_feature 4, 242: n = A,T,C or G
gagncaacaatgaaacctaaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctnctttgggcggttgtactgacactgatagtcattgtggccatttgcacactttccttctgcatatacaagcataacggtggcttcttcaggagacttgca

SEQ ID NO: 37069 - DNA, 152 bp, Homo sapiens
ggggccaaaatattaatatatattttttcttttaaatgctgttaagacactagtcactgtagctgatagcatgggttagtcaaccttcacaagtgattttaaaactgtgagagtatagccatagccctgagcttttcccaagacagcatccc

SEQ ID NO: 37070 - DNA, 481 bp, Homo sapiens
  misc_feature 18: n = A,T,C or G
tatggccggggaggtacngaaaattgtaattaagttcttagagctaggaagcggcagagatggaattgtgtggtgctgatgtcagaactcgtgtgtttaactatttcactctgttggcatattaagtcctcctttctattcatcgttatgcttatctaatacatgattccaccttgcttaggctgggatacctatgcctgaatatcagcaacctcctggtgatattttctcccatcactcatggaaatggaaaggcagtagaaagtagtgtagagactataaaaatcatacacttagatcaacctgggtgagagacctaactcagtcatttagttgtactgtgactttaggataattattctgcatttctataaactcaggtttgttagatgttacatggagctattaataaccctgtctactaggattattgtgaggattactctatagaagtaaggcttgtattgtacacgcaagtact

SEQ ID NO: 37071 - DNA, 452 bp, Homo sapiens
  misc_feature 3, 13: n = A,T,C or G
ggnaaccccaagnagcatagcaccactatttgttgagggccttcgtttttcatcttcccatggcagaaggtgaaagggcaagagagcacaaaagcaagagggagccaaacttgcttttataacaaggccattcttgtgatagctagcccactcctatggtaatgacataaatccattcaggaaggtagcaccctcataatttattaggtcccacctcccaatactgctgcattggaaattaggtttccaatgcatgaacttcaggaaacacattcagactatagcagggtgttcatagaaatatgattaaagtgttttgtgctcaaataagtttggaaaaggctcctcaaatgtgtaccagttgttgtattgtaggactgctcagagtctctcatatgcaaatgtatattgttgtttccagtagagggaagcagaaatggcaacatttgaac

SEQ ID NO: 37072 - DNA, 367 bp, Homo sapiens
  misc_feature 6, 33: n = A,T,C or G
ggctcncagctgcagcaagagaaactgtgtgtnaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttca

SEQ ID NO: 37073 - DNA, 127 bp, Homo sapiens
  misc_feature 25: n = A,T,C or G
tgtagtcccagctacttgggagtantgaggcaggagaatggcgtgaacctgggaggcggaacttgcagtgagccaagatcgcaccactgcactccactccagcccgggtggcatgagtgagactcca

SEQ ID NO: 37074 - DNA, 485 bp, Homo sapiens
  misc_feature 7, 33: n = A,T,C or G
gaaatcnccaaatctataattatagttggaganttcgacaacccctttttaacaattgataggacaactagacagagaacatcaaggatgtggaagaatgcaataataccatcaaccgacaggatctaattgacatgtatagaaccctacactcaacaacagcagaatgcacattcttttcaagtgcctgtgggacctagaccataacctggactataaatcaaacgtcatctaattttaaagaattaaaatcatatggagggtgttctctggccaaaatggagttacattagaaatcaataacagaaaaatctcctaatacttgagaagtaaatcacatacttcatgaatgggtcaaaaaggaagtcttgaggaaaataaatatatgaaatggaatgaaaataaaaacacaacatatcaaaaattgtgggacctggcaacaaatgaaaagcaaatttatagcactaaatgtatagattagaaag

SEQ ID NO: 37075 - DNA, 416 bp, Homo sapiens
  misc_feature 7, 34: n = A,T,C or G
gaaagcncaatctaaatgttatttccattttctngtgtgactgaagaaatatcaaatgtttcctagtaagacagcaactcagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacaca

SEQ ID NO: 37076 - DNA, 457 bp, Homo sapiens
  misc_feature 24, 52, 404, 454: n = A,T,C or G
cagtagagtatactaatatacctnttgtagttgataggaagattaaataatncatgtaaagcattgagaagagcgtctgacacatggtaggaacaaaataacttcttctttttttaatcagacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcnccatggcaggattccacatttcatagaatacaggttttcaagcaaacccntgt

SEQ ID NO: 37077 - DNA, 138 bp, Homo sapiens
caggctgcattggggccaaacacagcaatcagcaaagaggaggccatgcgctggttccagcagaagtatgatgggatcatccttcctggcaaataaattcccgtttctatccaaaagagcaataaaaagttttcagtg

SEQ ID NO: 37078 - DNA, 461 bp, Homo sapiens
  misc_feature 3: n = A,T,C or G
ggnagcccgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattac

SEQ ID NO: 37079 - DNA, 457 bp, Homo sapiens
gaaaccccttccactaacatcccgtaggagcttctctccctactgctgctacacaagcaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagagaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatc

SEQ ID NO: 37080 - DNA, 383 bp, Homo sapiens
  misc_feature 4, 33, 35: n = A,T,C or G
gggncgcccctgccatcaacgaagtggtaaccntngtaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccacttttcaaaaatctacagacagtcaatgtggatgagaactaatcgctgatcgtcagatcaaataaagttataaaattac

SEQ ID NO: 37081 - DNA, 343 bp, Homo sapiens
gctttcccggcggtgacgacctacgcacacgataacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 37082 - DNA, 461 bp, Homo sapiens
  misc_feature 8, 33, 34: n = A,T,C or G
atacaacnccagagtcctaaatcatattttccnnggctttatattttagtggaaaagtctagtaaccaaagtaagcataataattatcataacctgctatccataattctatcaccttaacagagctgtttttctcgtcagtgtgtactgttcatttgcagcatccactctgcatgaatggccttacgttcaactaggccaggggttggcaaactgtgccctctgtgccaaatcagcccacaacctgttattataaaatgaagttttactggaacatagtcatgcccattcatttatatattgcctgtggctgtttttccactaaaacagcagagttgaatagttgtgataaagaccatatgggctacaaaacctaaaatatttaccatctggccctttataggaaaagtttgctgactcttgggctagaccgtctacctacatgaccatggttggctaca

SEQ ID NO: 37083 - DNA, 263 bp, Homo sapiens
tcagttggttgagtatgagcattgaagttcaagctgggaagagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcattcacccttattagttcct

SEQ ID NO: 37084 - DNA, 460 bp, Homo sapiens
  misc_feature 3: n = A,T,C or G
ggntaccccaggccagtgacagaaatggattctttaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgt

SEQ ID NO: 37085 - DNA, 183 bp, Homo sapiens
  misc_feature 134, 157, 169: n = A,T,C or G
aggattacattggaggcaggtttgttaaatagtttggcagtttctcaaaatgttaaacacagagtagccatgtgacctgcagttccactcctagatgtgtgtgtgtgtgtgtgtgtgtgtgtgtgtgtgtatanacacacatacgtatatatactgntgagaaatgaanacacacattaactt

SEQ ID NO: 37086 - DNA, 333 bp, Homo sapiens
  misc_feature 6, 7, 35: n = A,T,C or G
atgaanncagaaatgaaaacctatatccctccctnaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagc

SEQ ID NO: 37087 - DNA, 181 bp, Homo sapiens
catcctggccaacatggtgaaaccccttctactaaaaacagaaaaattagccgagtgtggtggcgcgggcctgtagtcccagctaatcggcaggctgaggcaggacaatcgattgaacccgggaggcagaggttgcaagggagatcgtaccattgccagcccgggcaacaagatcaagact

SEQ ID NO: 37088 - DNA, 221 bp, Homo sapiens
  misc_feature 7: n = A,T,C or G
atttccnacacattttagcagctgaagagtatatgaggaagtagagatggcagttaggaaattggtctatcaatggtaggatagccagagaatgacttggatcaaaaagagaggttttcttcattgttgttaatgttctttcagccagtgcatcaattcatcctatttgaatgctgagactaaagagcttgagggcatgtttgaaaacatcagaacattag

SEQ ID NO: 37089 - DNA, 482 bp, Homo sapiens
gaaagccctatattggtggattcttgtccattttgcatctgctttaagaattaacgaaagcagtgtcaagacagtaaggattcaaaccatttgccaaaaatgagtctaagtgcgtttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacct

SEQ ID NO: 37090 - DNA, 491 bp, Homo sapiens
  misc_feature 4, 32, 35, 36: n = A,T,C or G
gaanggccaggtgcaaaaatctatcaccagcnttnntaggtgcagactgtgttggtggcggtaattttgtccatcaaatgaatatgtgtgaaaacattccctcctttggccctacaggtcagaatggcagcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatg

SEQ ID NO: 37091 - DNA, 481 bp, Homo sapiens
  misc_feature 2, 29, 31: n = A,T,C or G
gntcccaatcagtggtgggaacgacaaantngtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatg

SEQ ID NO: 37092 - DNA, 459 bp, Homo sapiens
  misc_feature 32: n = A,T,C or G
gaagggcccgcgggtaggcatggcggcgcacnttaagaagcgggtttatgaggaattcacgaaagtggttcagccacaggaggaaattgctactaagaaactccgactaacaaaaccaagtaaatctgcagcactccacatagatctgtgtaaagctacctcccctgcagatgctttgcaatacttgctccagtttgccaggaagcctgtcgaggcggaaagcgtagagggagtagtcaggattctcttggaacattattacaagagatggagtctctctgtgttgcccaggctggtcgcgaattcctgagctcaagcaaccctcctgcttggccctcccaaaggattgggattacagacgtgggctaccacatctgaccaaaatcaggatttctgttctcaagaagttttcgatctctcagtgatctattttccgagaatgatccatctgtgagactg

SEQ ID NO: 37093 - DNA, 190 bp, Homo sapiens
  misc_feature 3: n = A,T,C or G
agngaacctttactactatgatgctttggctgtctcataaaaacaagaacaatagagtgtaggctgggcgcggtggctcacacctgtaattctagcactttgggaggctgagacaggaggatcacttgaggtcaggagttcaagaccagcctggccaacgtggtggaacacttgtctctactaaaaatac

SEQ ID NO: 37094 - DNA, 240 bp, Homo sapiens
  misc_feature 3, 42: n = A,T,C or G
ggngccaacctaccgagcctggtgatagctggttgtccaagnatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacac

SEQ ID NO: 37095 - DNA, 463 bp, Homo sapiens
  misc_feature 31, 32, 33: n = A,T,C or G
gatgacccgcaacaatcttcttgatgtaccnnnttccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacatt

SEQ ID NO: 37096 - DNA, 479 bp, Homo sapiens
  misc_feature 9, 34, 36, 37: n = A,T,C or G
aagaaatcnccaggtatcaatggagtgagcccantnnttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtcta

SEQ ID NO: 37097 - DNA, 470 bp, Homo sapiens
  misc_feature 60: n = A,T,C or G
aagaatcccagacttctaaagtttctaaggtgcttttgttatcatccatacattaccagngtctcttttcttgggacactgtttccaaaaacattatgtagacttatattgccactatgtttaaagtaacatgaagaacgccaagagcattgctgtatttgtgatatagtttgtttacttaatactgtgtttcatgtttttgtcaaaaaactgaaacatgaatttaatttttctaatagaaaacattcagatttttaagtacatgctacgtacaagatattttatgaaattagtcaaatcaccttgaagataagggacatatggctaatcctcatataaagtaaactgaccttagagaattcataatgtaaagcagagatggcttttactagaatataaagcctttgaacttcaacctaggctgcttcctgtagtagacacagacaaccattggtttacagtagacattc

SEQ ID NO: 37098 - DNA, 461 bp, Homo sapiens
  misc_feature 7, 25, 32, 59: n = A,T,C or G
aactccnccagatgctactcccgancccggtnttgacccacgcgtgacccgggccaagnacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctc

SEQ ID NO: 37099 - DNA, 370 bp, Homo sapiens
  misc_feature 14, 45, 362, 369: n = A,T,C or G
tatggccgggagtnagcacgtttgcttaaaacctagaaacttatnatgttgcttttcatgtgctgtgccaagtcttgataatactttttcccccaaccaagggacctcataacctgattatggttattgctttacaaacagtttcgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctacanaaaaaang

SEQ ID NO: 37100 - DNA, 128 bp, Homo sapiens
  misc_feature 22, 128: n = A,T,C or G
cctgctgcagcagaaggagaanaaagatgagaagaaggaggagtctgaagagtcagatgatgacatgggatttggcctttttgattaaattcctgctcccctgcaaataaagcctttttacacatcan

SEQ ID NO: 37101 - DNA, 474 bp, Homo sapiens
  misc_feature 17, 40: n = A,T,C or G
tatggccgggaactgcncttcatttaatgccttaatgcantatacttcctcttctttttgcatggctttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcttgctagaaacccagtgtagcccagggcagatgtcaataaatgcatactctgtatttcg

SEQ ID NO: 37102 - DNA, 500 bp, Homo sapiens
aattttagtttgattcagatgctgaaaatcttggtgtttctatgtgttatacctgagaaaacaatgttacctttgataaattaaattaacaaaatgaggtagataattcaattgggagtaataaagccagggggcaaatttgatagactgtatagagatgaaaataaacatttatctaaaggtaattacagcagagttggctaacactggttgctaatacattaattttcttctcactttcccttgggatttaattcatgtgtccaaataataatgaaaatacccaatcaatggatttatctggagtttttgtctacgtgatgtcggtacaattggttttagaggtatagtgaaaattatgaaaagcatcttttcaagatatgtggtgttgtgggtgacagattttgcttcttggctaaagaagaggtaaaagagatctagttgctactgggagtacaacatgttgcctatacagtacagagaaagcagaaagagcatgt

SEQ ID NO: 37103 - DNA, 455 bp, Homo sapiens
  misc_feature 8, 34: n = A,T,C or G
caagaccnaaagcaataagtttgcaattgaaacngtcaaaaacttgctagaatctttaaaaggtaacagaacaggaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatggcaagattccatctca

SEQ ID NO: 37104 - DNA, 465 bp, Homo sapiens
  misc_feature 2, 13: n = A,T,C or G
gntttccccaagnatggcgccgaagcgaagatttagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaaca

SEQ ID NO: 37105 - DNA, 114 bp, Homo sapiens
cttgggaggctgagggagaactgcttgaacccaggtagtagaggtcgcagtgagccgagactgtagattgtaccattgcactccagcctgggcaacagagcgagactccgtctc

SEQ ID NO: 37106 - DNA, 461 bp, Homo sapiens
  misc_feature 7, 20, 32, 59: n = A,T,C or G
actcacnccatccagcaganaatggaaagtcntttttcctgaattgctatgtgtctggntttcatccatccgacattgaagttgacttactgaagaatggagagagaattgaaaaagtggagcattcagacttgtctttcggcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgt

SEQ ID NO: 37107 - DNA, 459 bp, Homo sapiens
  misc_feature 32, 34: n = A,T,C or G
ggattcccgtgagtttttccggtgcacgcgantntcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgcccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtcca

SEQ ID NO: 37108 - DNA, 496 bp, Homo sapiens
atttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacttcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttt

SEQ ID NO: 37109 - DNA, 477 bp, Homo sapiens
  misc_feature 59: n = A,T,C or G
ctgaacccaactggaatcacatatttcacaacttggccgaagagatgactataaaatgntcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctc

SEQ ID NO: 37110 - DNA, 179 bp, Homo sapiens
aagaatgttttcattaatcaagaacgaaagtcggaggttcgaagacgatcagataccgtcgtagttccgaccataaacgatgccgaccggcgatgcggcggcgttattcccatgacccgccgggcagctttccgggaaaccaaagtctttgggttccggggggagtatggttgcgaagc

SEQ ID NO: 37111 - DNA, 463 bp, Homo sapiens
  misc_feature 7, 16, 33, 35, 43: n = A,T,C or G
cattgcnccaaaaagnagatcactgtgcagaantncccacagnaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcag

SEQ ID NO: 37112 - DNA, 500 bp, Homo sapiens
  misc_feature 147: n = A,T,C or G
gtggaacgcctagctcttgtcacacgtggtgaaattgcctctacctttgatcacccagaactggtgaagcttggaagttgcaaacttatcgaggaagtcatgattggagaagacaaactcattcacttttctggggttgcccttggngaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgaatggagtcttatgctaaagcactgagaatgttgccaaccatcatagctgacaatgcaggctatgacagtgcagacctggtggcacagcttcaagggctgctcacagtgaaggcaataccactgctggattggatatgagggaaggcaccattg

SEQ ID NO: 37113 - DNA, 334 bp, Homo sapiens
  misc_feature 38: n = A,T,C or G
cggtgacgacctacgcacacgtttaacatgcctctcgnaaaggatctccttcatccctctccagaagaggagaagaggaaaacacaaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttt

SEQ ID NO: 37114 - DNA, 499 bp, Homo sapiens
gtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattga

SEQ ID NO: 37115 - DNA, 233 bp, Homo sapiens
  misc_feature 23, 25, 50: n = A,T,C or G
tcctgaagctgacagcattcggntngagatgtctcgctccgtggccttanctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaag

SEQ ID NO: 37116 - DNA, 462 bp, Homo sapiens
  misc_feature 6, 60: n = A,T,C or G
gaaggnccccgaggcagccagcgcaggggctttttgctgagggggcaggcggagcttgangaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagat

SEQ ID NO: 37117 - DNA, 114 bp, Homo sapiens
aattattaatctgaaaatagcaacccagaatgtaaaaaaagaaaaaactggggggaaaaagaccaggtctacagtgatagagcaaagcatcaaagaatctttaaggaaggtttt

SEQ ID NO: 37118 - DNA, 179 bp, Homo sapiens
  misc_feature 17, 24: n = A,T,C or G
gttaatagcccctcagnaagtatnttccctgctgataacagcatcctattttacttacttttatagcattactgtgcctagtcgtggggaaagagatggggctgtatagattatctgaatcatttgtctaagaggtacattcttccagatggaatcaataacttttttttttccaggtt

SEQ ID NO: 37119 - DNA, 499 bp, Homo sapiens
  misc_feature 24: n = A,T,C or G
cacctagtaaaccttctgtctgcnctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtga

SEQ ID NO: 37120 - DNA, 113 bp, Homo sapiens
tatttcaatagaagaagcaggctcagatttgattgtgagctcgttgtcagaccatgcaaaatgtgaaatattaccagttacaacacacataggtaaaaagagaccagttaccc

SEQ ID NO: 37121 - DNA, 178 bp, Homo sapiens
  misc_feature 24, 114: n = A,T,C or G
aagtatataataccaaaacgcagnctgtttaaattaggatttccaagtaatttacgtcgtcttcaaaattcctggggtctatcaatcagaaacgccagaaagtttgtgtactangtttcacattgttaagggagtatctataataaaattcaaatgcgttattttaaaaaaaaagggg

SEQ ID NO: 37122 - DNA, 147 bp, Homo sapiens
  misc_feature 4, 100: n = A,T,C or G
aggnggtatgatattccaggcagctcaatgattatcacatttgagaccctgtgtttgaagcatttacaggcaatgtacagcaacagaggtacctcttggngtatagtatttacattctcttttaggtagaagaggcaattttaccct

SEQ ID NO: 37123 - DNA, 123 bp, Homo sapiens
  misc_feature 117: n = A,T,C or G
tcactatcacaagaacagcgtgggggacactgccccctgatcccagtcacctcccagcaggtctctccctcgacatgtagggattatggggattacaattcaagatgagacttgggnggatac

SEQ ID NO: 37124 - DNA, 116 bp, Homo sapiens
agaaatacaagcctgtgagacagagagatctaggagatccctagagaggtccatcaagacctccaggatgaaattacctcatttagctcaatttctcacctctccgttagtgcttt

SEQ ID NO: 37125 - DNA, 100 bp, Homo sapiens
  misc_feature 3, 5, 54, 65, 72, 86: n = A,T,C or G
gancnactactcctggcctttaatccatcttgagttaatttttgtataagttgnaaggaaggggnccagttncaaattttctgcgnatggctagccactt

SEQ ID NO: 37126 - DNA, 281 bp, Homo sapiens
  misc_feature 16, 23, 181, 183: n = A,T,C or G
aagttccatgaatctnacccagngccttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagngnggaagaaaacagcagttcttttataattgcttgaaattaggaaagcgcttatttcctagaagcaaataaatgtttaagtaaataaaggctacattttg

SEQ ID NO: 37127 - DNA, 170 bp, Homo sapiens
  misc_feature 16, 23: n = A,T,C or G
tagtaaacatgctagngggaaancaaatcgataaggtaagaaggcagacacttggcattttggttctatattttggtagcctttcttaatcattgcatttatattttaggaaaatcgtgaagtcgatagaaatgaaggcctgaaatttgcacgaaagcattccatgttat

SEQ ID NO: 37128 - DNA, 180 bp, Homo sapiens
  misc_feature 19, 20, 84: n = A,T,C or G
gaaggaaagatgagaaggnncaaggacagccacacacactacctgtccacttgccctggtctttctcacctccgccctcttggnccttagcaagctcctctggatcagcagctgtttcactgggtccttcaacatcttcaatggcttcttctgaaacagaagaaaaacatgtcaagggtg

SEQ ID NO: 37129 - DNA, 283 bp, Homo sapiens
  misc_feature 23, 175, 180, 220: n = A,T,C or G
ctgtaatatggaaactggggaancatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgangggcngctggcattccttcgacttctctccagccgagcttcccanaacatcacatatcactgcaaaaatagcattgcatacatggatcaggccagtggaaatgtaaag

SEQ ID NO: 37130 - DNA, 207 bp, Homo sapiens
  misc_feature 2, 6, 49, 57, 91, 155, 161, 163: n = A,T,C or G
gngagnccaaagaggaacagctctttggacactaggaaaaaaccttgtngagagagnaaaaaatttaacacccatagtaggcctaaaagcngccaccaattaagaaagcgttcaagctcaacacccactacctaaaaaatcccaaacatataacngggggncncacacccaattggaccaatctatcaccctatagaagaactaatg

SEQ ID NO: 37131 - DNA, 227 bp, Homo sapiens
  misc_feature 16, 17, 178: n = A,T,C or G
cttccctgtaatcctnnctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcacnccaagattatggcctcgggcaagtgctgttggtgagagactctggagtt

SEQ ID NO: 37132 - DNA, 305 bp, Homo sapiens
  misc_feature 19, 20, 77, 295: n = A,T,C or G
atgcaaaagcaattagggnnaaaactgctggtggtgccttaccacgaatcaaggcagtaacagcaaacaactctggnagttgtattcttcagaagacaaaaccttagattttccttaagaatgtctgtgatgaaagagtaaaaatttgtcaggtgctgcagctcatgccctgtaatcccagcactctgggaggctgaggcgtgtggatcagttgaggtcaggagttcgagaccatcctggctaacatgctgaaaccccatctgtaataaaaatacaaaaattagccaggcatggnggcggggcac

SEQ ID NO: 37133 - DNA, 250 bp, Homo sapiens
  misc_feature 17, 26, 110, 180, 183, 184: n = A,T,C or G
tgtgatggcaaaaaaanaacacagcnccatgtagtcatctgcatgcagtttactcaaatgtgggagacagtcaagatactgtggttgagaaataaaagcaaaaacgaggntattacaaaagaagagagaaagaaactaccactgggaaaagggtttgtaagcattgagtcttggtatagnggnngggggtaaactgattagctggcagctaccaaagaggtcagctggggctgtctgtccttgtgcagac

SEQ ID NO: 37134 - DNA, 346 bp, Homo sapiens
  misc_feature 2, 4, 51, 59, 214: n = A,T,C or G
gnanttcctcctgtgtcttcatgttctctgttttccttcggccattgtatngatgaagnaggcattgtcaccatgtgccatggctcacccctgtaatcccagcactttgggaggctgaggcaggaggatcacttgaacccaggaatttgagaatttgagaccagcctggtcaacatagcaagaccctatctctatgaaaacaatttaaaaatcngctaagcgtgacagcctgcatctgtaatctcagctacttggaggctgaagtgggaggatccttagactcagggagctgaggctgcagtaagacgactgcatcactgcactgagcctaggtgacagagggaga

SEQ ID NO: 37135 - DNA, 215 bp, Homo sapiens
  misc_feature 145, 147, 199, 202: n = A,T,C or G
ctacatttcttagactacatttagagaactgtggccgttatctggaagtaaccatttgcactggagttctatgctctcgcacctttccaaagttaacagattttggggttgtgttgtcacccaagagattgttgtttgccatacngngggggaaaaattcctttgtgtttctattgacttcaatgatagtaagaaaagnggntgttagttataga

SEQ ID NO: 37136 - DNA, 217 bp, Homo sapiens
  misc_feature 2, 3, 152, 154, 156: n = A,T,C or G
cnngaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgngngngggggaattatgcagaagaatggagctggattacacacagcaagttcctgcttctgggaca

SEQ ID NO: 37137 - DNA, 215 bp, Homo sapiens
  misc_feature 23, 25, 167, 188, 212: n = A,T,C or G
gcgaaggtggcaagaagaagccncngaaacagcccaagaagcaggccaaggagatggacgaggaagataaggctttcaagcagaaacaaaaagaggagcagaagaaactcgaggagctaaaagcgaaggccggggggaaggggcccttggccacaggtggaattaanaaatctggcaaagggggggcngttccttgggcctgaggagatggngac

SEQ ID NO: 37138 - DNA, 260 bp, Homo sapiens
  misc_feature 3, 5, 159, 163, 165: n = A,T,C or G
atncnccaccatcttcaaagaaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaangggngnggcctcctcctcctcctcctcttcctcttcttcttcaacaattcggaaaatcaagtcttccaaaaattcagctgctaatagagaattacagaaga

SEQ ID NO: 37139 - DNA, 106 bp, Homo sapiens
  misc_feature 2, 39, 74, 92, 93: n = A,T,C or G
ancaacattgtaaaagaggctatagaaagcgcaattggnggtaacgcttatcaacacagcaaagtgaaccaggnggaccacaaatgtagtannaacaaactttaag

SEQ ID NO: 37140 - DNA, 161 bp, Homo sapiens
  misc_feature 4, 5, 122, 154: n = A,T,C or G
aagnntagtaaaaggcaagtcagattaaaggttgaaacatgaagatattctcaattgtatttctgcctatgtttgcttttttggctcaagcatctgttggaagagacaaaatgtgacttggntcataataaagcaagaattatttactctcggnggggggg

SEQ ID NO: 37141 - DNA, 194 bp, Homo sapiens
  misc_feature 17, 25, 175, 179: n = A,T,C or G
gtcggcaggttcgaggngaggcgcnctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagngggnacgatttttaaggac

SEQ ID NO: 37142 - DNA, 281 bp, Homo sapiens
  misc_feature 20, 22, 173: n = A,T,C or G
tattgaataggtagaaggancntcttttcatcatcacagaaagttctattggacagtgctcttctagatcatcataagactacagagcacttttcaaagctcatgcatgttcatcatgttagtgtcgtattttgagctggggttttgagactccccttagagatagagaaacnggcccaagaaatgtgctcaattgcaatgggccacatacctagatctccagatgtcatttcccctctcttattttaagttatgttaagattactaaaacaataaaagct

SEQ ID NO: 37143 - DNA, 135 bp, Homo sapiens
  misc_feature 2, 8: n = A,T,C or G
angagaanctttaggcaaaatcaaaagtatttgcggcaaaataaaggcctattctactcttatttagagtgaaacactgtatacttgtttctctccaaagcgaaattaagtatttataatttcaattgcctcgat

SEQ ID NO: 37144 - DNA, 100 bp, Homo sapiens
  misc_feature 61: n = A,T,C or G
gaagcctccttagtacattaaagtattgttaatgcaacagtaccaccagaagactctgggngattgatcgggataaagttgatcatctgtctgttaaagt

SEQ ID NO: 37145 - DNA, 124 bp, Homo sapiens
  misc_feature 116: n = A,T,C or G
aacagggtgatcttcatgttattgttttatacaagtgatggaaatgtaccttgccttgtttagaggcaatttcacatttataaatatttttttttcctccatgaaacttacgcagnaatcacta

SEQ ID NO: 37146 - DNA, 102 bp, Homo sapiens
  misc_feature 83: n = A,T,C or G
gaggaattaatgtgaattgcaggacacattgatcatcgacacttcgaacgcacttgcggccccgggttcctcccggggctacncctgtctgagcgtcgcttg

SEQ ID NO: 37147 - DNA, 247 bp, Homo sapiens
  misc_feature 2, 49, 156, 160, 211, 224, 240: n = A,T,C or G
gncgaaaccatgaagagcctgatccttcttgccatcctggccgccttancgggagtaactttgtgttatgaatcacatgaaagcatggaatcttatgaacttaatcccttcattaacaggagaaatgcaaataccttcatatcccctcagcagagngggnggagctaaagtccaagagaggatccgagaacgctctaagcctgtccacganctcaatagggaancctgtgatgactacanactttgc

SEQ ID NO: 37148 - DNA, 152 bp, Homo sapiens
  misc_feature 1, 24, 132: n = A,T,C or G
nccgtgtgctgccacaggccccancatcaagatctgggatttagagggaaagatcattgtagatgaactgaagcaagaagttatcagtaccagcagcaaggcagaaccaccccagtgcacctccctggcctnttctgctgatggccaaactc

SEQ ID NO: 37149 - DNA, 140 bp, Homo sapiens
  misc_feature 1, 2, 57, 92: n = A,T,C or G
nngcagccatacatttctgctgagtttatccaaaatacatatttagagagaattttncaaaacttctcatttgattaaaattgtgttgcagnctaatacatccatgagaaatggacatacttaggcctagtatatgtaat

SEQ ID NO: 37150 - DNA, 133 bp, Homo sapiens
  misc_feature 23: n = A,T,C or G
ctcaaaagccaaaaaaggggagncaatttcacatggactttggaaaatatttttttcctttgcattcatctctcaaacttagtttttatctttgaccaaccgaacatgaccaaaaaccaaaagtgcattcaac

SEQ ID NO: 37151 - DNA, 228 bp, Homo sapiens
  misc_feature 2, 4, 146, 160, 207: n = A,T,C or G
cncnagatttattactcatttatggctaagtatatcacaaataaatgttaggtcccctagtgagtattcagcaatcatttccttgggatctaaggcataccaggtgctatgttcaaaatgaatgggacatggttcttgtttttaanatgctcccaggggngggggggcagactggtataaaaataactaactgtcggccaggcgcangaggctcacacctgtaatccc

SEQ ID NO: 37152 - DNA, 122 bp, Homo sapiens
  misc_feature 2, 25, 86: n = A,T,C or G
gngctcgatctgatgcttaatttanccacaaggcaagacttaaaggagcttctgtcaactctgttaaaaggaaatccaaaggtagnctaaaaaggtaaaatttgaggaacatagttgaggta

SEQ ID NO: 37153 - DNA, 269 bp, Homo sapiens
  misc_feature 37, 149, 157, 158, 210: n = A,T,C or G
gattcattactcaaaacactaacaaatctcaatcagntgttggttgccacattattcaaaatactgatagttgtgaatgacttactttttattctataaattaggtcatagccaatatttcagtacacaaacattatttttattcattnggggggannatgttttcttaaattgtaggaaaaaccggtagcatatcaaacagcaaaccanaaattatatcttactgctacatctcataactacatcttactaaaacacaaacattcata

SEQ ID NO: 37154 - DNA, 275 bp, Homo sapiens
  misc_feature 2, 11, 150, 161, 213, 214, 241, 250, 256: n = A,T,C or G
cnaatggtgtnaactcatccttttttatgggtgcatagtattccatattgtatatgtgccacagtttccttatccagtctatcattgatattgcatttgagttggttccaacaccttgttattatgaatagtgctgcaataaacatatgnggggggggggntttatagtagaatcatttataatcctttgaatatatacccaaaaatgggatnnctgggttgaatgttatatctggtctanattcttgangaatcnccacactgtcttctacaat

SEQ ID NO: 37155 - DNA, 138 bp, Homo sapiens
  misc_feature 60, 81: n = A,T,C or G
actgttagtccaaagaggaacagctctttggacactaggaaaaaaccttgtagagagagnaaaaaatttaacacccatagnaggcctaaaagcagccaccaattaagaaagcgttcaagctcaacacccactacccga

SEQ ID NO: 37156 - DNA, 127 bp, Homo sapiens
  misc_feature 2, 8, 45, 62, 105: n = A,T,C or G
gncattgnacccatggacataggagggcccgagcaggaattcggngtggacatagggccggnctgcttcttgtaaaaacctgaacccagaaacaacacaatccgntgaaacccaaaggacccaagta

SEQ ID NO: 37157 - DNA, 189 bp, Homo sapiens
  misc_feature 18, 19, 148, 178, 182: n = A,T,C or G
tgcaaaaataatcatganncaacctggatgcctcattatgtcaaccaggtccagatgtgctataatctgtttttacgtatgtaggcccagtcgtcatcagatgcttgcggcaaaaggaaagctgtgtttatatggaagaaagtaaggngcttggagtttacctggcttatttaatagngcgnataacct

SEQ ID NO: 37158 - DNA, 295 bp, Homo sapiens
  misc_feature 1, 2, 155, 159, 178, 245: n = A,T,C or G
nnggcctaggattagaaaggctagccaacgatcctctacgacatccctgatatccgtctcttctggtgtgaggacgagcgcttcctgaagcagttctgtgtatccaacattaatcagaaggtgaagtttcagcctcttagcaaatatccggctgngagnggggatatttcattctggntgccctctgagaattacgcagaaaatgatttctatgacttagtccgaacaattggaggagacctggnggaaaaggttgatctcatagacaagtttgtacacccaaagacgcacaaga

SEQ ID NO: 37159 - DNA, 303 bp, Homo sapiens
  misc_feature 18, 25, 180, 184, 291: n = A,T,C or G
tgtgtcaatgtttgggancatctcnggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagccngggntccactggctcctgctgaggtcccctttccttctgggctgtgaattcctgtacatatttctctactttttgtatcaaggcttcaattccattatgttttaatgttgnctctgaagatga

SEQ ID NO: 37160 - DNA, 234 bp, Homo sapiens
  misc_feature 2, 4, 107, 164, 186, 230: n = A,T,C or G
cngnccaactatatctcattgaaaataaagtcattggggatttttacctctaatttggatggaaagcacaagaagccacacattcattaatatgcaacaaatgttgnatttatgttactgaatatttctatggattaaaatagaaaaagtttaatggggggggncttttaaattttaataacaggntcaccagctggtagaaaatagagacacatgatgatttgcattgnaata

SEQ ID NO: 37161 - DNA, 365 bp, Homo sapiens
  misc_feature 15, 171, 176, 228, 341: n = A,T,C or G
cagaacactttcatnacctcccaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctcnaaggnagcataatgtttttaaagctcatccatgttgtagcataaatcagtacattgntttcatgtttaaataatattccattgcatgtatatgccacattttatttgtccatttatcatttgatggacatttgggttttttccaccttttgattataataatgctgctgngaacatttatgtaaaagttttttg

SEQ ID NO: 37162 - DNA, 235 bp, Homo sapiens
  misc_feature 76, 180, 182, 184: n = A,T,C or G
agactttaagcacatacgagagcccgagaaaatagtatagtgaacccgcatcacccacttcaacaattagtcaagncatgcctcatctgtacctccacccacttcccctgcccccctcacactggactattgaaaagcaaatcccagacatggtataatttcatccattattatatgcgngncnaatctgaaaccaaacacccttaaaaatcataaccacaataccatcatcaca

SEQ ID NO: 37163 - DNA, 148 bp, Homo sapiens
  misc_feature 16, 21: n = A,T,C or G
agtccattgagaccgngggcnccaccttcttcacctttgcaaggcaggagggccggaaggatagcctcagcgtcaacgagttcaaagagctggttacccagcagttgccccatctgctcaaggatgtgggctctcttgatgagaagat

SEQ ID NO: 37164 - DNA, 229 bp, Homo sapiens
  misc_feature 1, 10, 146, 198, 199, 203: n = A,T,C or G
ngggatgtantaacttgccaaggctacacagctggtaagtggcagccggagatttcagcaaggcctgtcagactccaaagcctatgttctttctagcaccccaccccgcttttcatgtaaactcttgctcccaaaaaatgcgtgtncctgggggggggggcatgtggttttataataaatggttgtaatacctgtatnnccanatttctctcctcatatacttaaccca

SEQ ID NO: 37165 - DNA, 128 bp, Homo sapiens
cgtgtccctggcattttaagtgtcggttgggtaggcagtcatggatcaggtaatgcaagtttgttgagccaagtcggcagtttgtaaaggactccattcggctggttaaaagatgcactaaacctgat

SEQ ID NO: 37166 - DNA, 121 bp, Homo sapiens
  misc_feature 12, 15: n = A,T,C or G
caaattctgtgncanttttaaaaagttaagctgctatagtaagttactgggcattctcaatacttgaatatggaacatatgcacaggggaaggaaataacattgcactttataaacactgt

SEQ ID NO: 37167 - DNA, 100 bp, Homo sapiens
  misc_feature 99: n = A,T,C or G
ctggaacatggtatagtatttgcatataacctatgtgcatcctcccgtacacttgaatctctacactataatacctaatacaatgtaaatcatttgganc

SEQ ID NO: 37168 - DNA, 261 bp, Homo sapiens
  misc_feature 23, 176, 177: n = A,T,C or G
gatgccatagttttcgggactgnccgtttggagtagatactggtctgtgattggtggaatggagaacacacgtgttggtgcttctgggtagcactggtttgcattagtttatgtttccatgccagagtttgtgtgggcggggcgcatgtgctccacagagtgcactcgaggggacnngggggcacaggatttcataattgtcattgtcacactttcaaatttttgtacatcagtgaatttttttatattaaaagggtgagc

SEQ ID NO: 37169 - DNA, 247 bp, Homo sapiens
  misc_feature 6, 9, 32, 92, 104, 124, 135, 158, 165, 242: n = A,T,C or G
acatcnagnaccaaacattgacaacttcaggntaactctgagagctatcaaactatgggccaaacgccacaacatctattccaatatattanggtttcctcggnggtgtttcctgggctatgcnagtagcaagancttgccagctttatccaaatgcnggggggncaactcttgtacataaatttttcttggtattttctaaatggtatgtgtttagattatattaaaataaaattgattgnagaca

SEQ ID NO: 37170 - DNA, 349 bp, Homo sapiens
  misc_feature 328, 339, 349: n = A,T,C or G
attggcctagcatttgaatatttatgctaagtgtgaagatgatggtaagagtcctttgcttttgtgaagctcagatccagtgacatgtaagtaaataagcgtaatagtatgtgactagtattatacaggagggatgttctgtgtgttgcataggaacacaggaagggaatgatcatctctggagtaggggttaggggaatgtgtagctgtttcaagaaaagattcacggggacatttaagttttcttaaagagttgattacagttttaagcagacaagaatcagactctgatagcttccttttttataccgttctttttttttttganacggagtttcngcttttgttn

SEQ ID NO: 37171 - DNA, 495 bp, Homo sapiens
  misc_feature 5, 49: n = A,T,C or G
tggcngggaaagtaagccatgttagtttatctttgtgatctctctcagnctttatattttatattgttagaaaatgtgtacatttcgttggtaaaattatataacttttgaaccttcaaatgaatattttgaaagtagagttggtcacagtagaaaagatttcctttcacaagattattagtcttttcaaacaacaataataaattgatacttttaagaagtttaggagttgtgaatgtggtaaaactgaacctttccagtgatttagtggaaaggtcttatcaatcttaattttttctttttcatgaaagtttctgcatttgtataaatcatcaatattttctgttctagggaggtgttgtagcaggaaatgtggctcatattctggactcaaatcatggaaagaaggcattactgtacactgcggtaaatcagttggctgtgggaagcagttcagcagaagatgaaaaaaatactgcactaaagaccattcag

SEQ ID NO: 37172 - DNA, 215 bp, Homo sapiens
  misc_feature 106, 138, 203, 215: n = A,T,C or G
attcttaaaacttttttttttgtcaaaaagtataacttatgaaacagcatgtagattaggggaaattttacttcattaaaacaatccattctcaaagacttctcanggaacttttattttcacagaaagaaaaataancctttaaagggatgcagagttaatgtaaaacgtttttcaaattttcttatgtcagacttcatttngaagtaaagaan

SEQ ID NO: 37173 - DNA, 207 bp, Homo sapiens
atgagtaggttgtgaaaattttctcccattttgtaggttgcctgttcactctgatggtagtttcttgcccaggtttataagagtacatttcatgaactcatctcagcccattcctggctcaagaaatcaccaagattttatgaatagaactgttctaatattcttccagactcctttcaacaattactatcctgttcattccatcct

SEQ ID NO: 37174 - DNA, 166 bp, Homo sapiens
gtgattattgaacctcttaagcagagaatatcttgatgatcatctagttccactctcatttatacatgaggaacctggtattgaaactaatatcagtatcccgaaggaaggagggtaattggagaaaaatcagaaataaaaggtaattgattagaaggtgaaagtc

SEQ ID NO: 37175 - DNA, 404 bp, Homo sapiens
  misc_feature 45: n = A,T,C or G
gaaataagccggaacagaaagttaaacactgcatgttctcactcntatgtgaaagctaaaaaatgttggtctcactagaagtaaaaagtaagacagaggatagataatagaggctgggaagggtaggaggaaggaagggatagggagaaatttgttgaaggatacaaaatttcagctagatagaagaaataagttctagtgttctataccactgtaggatgactgtagttaacaatactatatagtttcaaatagctggaaggaagatactgaacattcctaacacaaagaaatgataaatatttagataatggatatgttaattaccttgatttgatttctgtacattatatgtatcagaacattatctaccccatgaatatgtatgattattatttgttaat

SEQ ID NO: 37176 - DNA, 120 bp, Homo sapiens
  misc_feature 9, 64: n = A,T,C or G
gcatgcccnaactctgccagcccccacctgccaggacgttctagcaggacatcggtgctttgcngtccatcttcccatgctgcaatttcttcctgagatttctataaatataaatgtatg

SEQ ID NO: 37177 - DNA, 471 bp, Homo sapiens
  misc_feature 45, 153, 165, 169, 188, 222, 224, 241: n = A,T,C or G
agagttttttttttgagatctttctggatctccgtatttaaagtngtaattccactttactgttttcctgctctttctatcccccttctctgcttagttttccttcactgcatttgtcaccttctcatataaacataatttacttttttgttngtttctttgttngggnctatcttccttactgaggngtaatttccctaaaggaagggatttctgtctttngngtttactgctatccagngcttagaaaaggcactgtatgaatacttattcagacatccatgcaaaagtatttagtcagaacttttacttttttagagatattgaccttgttttaaatttttattatagtaaactctaacttagctgaaatgtaaacaattagaaagttaatatcagcaacttttaaaaactcttattttatgagagacttatgtcttcttctgcccacaccctcaaatcacgaattta

SEQ ID NO: 37178 - DNA, 475 bp, Homo sapiens
gacaggatgaataaaataaatctataacttgacagattattgtgaaactaaagaatgttaataacaaaaagaaactcttgaaagaacccagaaagacaagatacatttacttcaaatgaatgccacttagatagacagctgacttcttctcaacaccagtagttactagaaaaagcagagcagtggcttcaaagtgctgcagtaagttggagttcaacctagaattttattttcagctatactatcatttaggaattactttcagatctataacaattgagagttcaaacttctattaaaactactttaggagaaaaatgtcattagctcaacaattaatacataaaatgtatatttgattataacataacctttcaaaaaataagggtaaaatactggaaaggaattaaaggagaaaagagaataacttcactgagtagttaaactgttcttggatctgtgacatgtttaggat

SEQ ID NO: 37179 - DNA, 336 bp, Homo sapiens
  misc_feature 327, 328: n = A,T,C or G
cgggtgatgcttacatgaaaccgtattaagaagagctcatctaatcagtctactctgagcatgagtccaggcaaaatctggacgtttgcttttgtaattcagcttcttgtctagcatttctattatcaattcaaagccaatgctctttagtacaataaggggcagtgtcttacagtggttcacactgctgctcttgagccagacagcctggctttgtccacttactagctttgtgacgtcaggaaagttattttaatcactctgtgcctcaagttctttatttgtaaatcaagataataatagtagttacaaagtaaaggctaaagnnaataaaga

SEQ ID NO: 37180 - DNA, 105 bp, Homo sapiens
caaacaaaatccttgaggttggtatacaagttaaggctgaaaaaaggccttaaattcccagtaaagaatgtgaaagcaagcatgtaaaataaactggtcttcatg

SEQ ID NO: 37181 - DNA, 471 bp, Homo sapiens
  misc_feature 23: n = A,T,C or G
gggtggtattggagaaagaagangaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatcttttgagaccgttgtcaagtgtacacaactcacatccttcatattgaaggtgactcatttttc

SEQ ID NO: 37182 - DNA, 467 bp, Homo sapiens
gatcttgagccccgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactac

SEQ ID NO: 37183 - DNA, 467 bp, Homo sapiens
ctgattaataggagccaattcgttgcccttttttctattgttcattttcctcaactgttcccattgcctctgttcttcactcatttaggcatagaggtcatcttaatttcattttccagattacctaaagattgtgactacttttactaagagaagttttcctctcctaatggacccaacattcccactgagagtttctggaacccaaagaccaaatggaccaaatatcctcataatattttctgtaactatgatcttcagtaaattcctgtactttggaagtgtgtttgaattaggtttctctcatagtagagaagtaggagttagcatataaatgttaaagtattttatacttctgacagtctattcacatattgatattttttatttaggaacatgcattggcccaagctgaacttcttaagcgccaggaagaactagaaagaaaagccgcagaattagatcgt

SEQ ID NO: 37184 - DNA, 341 bp, Homo sapiens
  misc_feature 282: n = A,T,C or G
gacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtganaatggctgtgtggtgagtgtgaactttgttctgtgatcatagaaagggtattttaggct

SEQ ID NO: 37185 - DNA, 156 bp, Homo sapiens
atgtaagaagagatgaaagagaaagcagaaggcaaaaattctgctgtccaccatacaacaaagtatccatggggccagaacctgtaaggaagctagacccccgctctccaggcaatatgaagggtacaaaagagtaaagccaggaggctcaaaggt

SEQ ID NO: 37186 - DNA, 149 bp, Homo sapiens
gaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagctttccc

SEQ ID NO: 37187 - DNA, 474 bp, Homo sapiens
  misc_feature 6: n = A,T,C or G
agaganctgaaattctgcctcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacac

SEQ ID NO: 37188 - DNA, 173 bp, Homo sapiens
  misc_feature 6, 7, 41: n = A,T,C or G
ataaannttgtaaatgaagttgacgactatttacctgagantttggacttagaattgatgctgtaattggttgagtttttggaggttgttggcaaagggaaatatattttatgtaggggaggtggattttgggggcttttgggggctagagggtggcttgaatgatgcacccg

SEQ ID NO: 37189 - DNA, 473 bp, Homo sapiens
ggaggaagacgcggtcgtaagggctgaggatttttggtccgcacgctcctgctcctgactcaccgctgttcgctctcgccgaggaacaagtcggtcaggaagcccgcgcgcagcagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggggggaagtcaccattgcaga

SEQ ID NO: 37190 - DNA, 217 bp, Homo sapiens
gctgaggtgggtgcctggcagagtgcatgctccctccgcgcctggataagccctcaattacaatgggcaggagcctggggccatgaagatggagatggcatcctggtgccaaactcctttcagttccttacatctttcttgcaaaatgatctgctagctttaagtatattctttgcttaaggcaaatttccttggaatgaggtgaagaaaaggagga

SEQ ID NO: 37191 - DNA, 477 bp, Homo sapiens
aggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagga

SEQ ID NO: 37192 - DNA, 490 bp, Homo sapiens
  misc_feature 37, 43: n = A,T,C or G
gtcctaaaataattatgctgagtaaaagtaggccagnacaagnaaaattacttactgcatgatcctatttacataaaattccagaaaatgcaaactaatatacagttccagagagcagaccagtggttgtgtgggagtggaggtagggagggctgggaggagagattacaaagcaacactagggaagttctgggggtgacagctaccgctcactgtcttgactgtggtattatgattgtgtacatatgtcaaaatttatcaaatcatacactttatgtgcaagttattgtatatcaattatgcctcactcaagttgttataaattaaaagctataactgaaaaaagttctagaacaattcaggcctcagaaagcacccattatatgtcagtccctacattttatttttgatgttccataccacattaagcatctaagaggagagcaaattcaaactgactcacaagatgaaatatcactgacaataattt

SEQ ID NO: 37193 - DNA, 356 bp, Homo sapiens
ctcggaaaaaaaattaataataaataaataaataaaaggaaactatttcaacatagtaaaagccatatatgaaaaatacagtgaatgtcatattcagtggtgaaagactgaaaagattttcctctaagatcaggaacaaggcaagaattcccactttcaccaattctattaaatatcatactggatattccatccagagcaattaggcaagaaaaagaaaaggcatccaaattggaaagaagtaaagtggtctctgtttatagatgatatgatcctgtacatagaaaaccctgaagagtcagcattttcatctaacaacaatatgaaaaagaaattaagaaaacaatttcatttac

SEQ ID NO: 37194 - DNA, 363 bp, Homo sapiens
ctcggaaaaaaattaataataaataaataaataaaaggaaactatttcaacatagtaaaagccatatatgaaaaatacagtgaatgtcatattcagtggtgaaagactgaaaagattttcctctaagatcaggaacaaggcaagaattcccactttcaccaattctattaaatatcatactggatattccatccagagcaattaggcaagaaaaagaaaaggcatccaaattggaaagaagtaaagtggtctctgtttatagatgatatgatcctgtacatagaaaaccctgaagagtcagcattttcatctaacaacaatatgaaaaagaaattaagaaaacaatttcatttacaatagcat

SEQ ID NO: 37195 - DNA, 385 bp, Homo sapiens
  misc_feature 379, 381: n = A,T,C or G
ggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggagggctcgtcttaaaacatgagcattaaatatatttggaatagcagaaggttaagtaatttcttatgtataggttaaactaaagcagtacttcagtgggacttaacaagtattttttcatcactgaaaggttttttttttttttnancact

SEQ ID NO: 37196 - DNA, 386 bp, Homo sapiens
  misc_feature 10: n = A,T,C or G
ggaccttttnaactgaagagaggaggctggctgcatcatgggagaagagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcacca

SEQ ID NO: 37197 - DNA, 324 bp, Homo sapiens
caatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaag

SEQ ID NO: 37198 - DNA, 357 bp, Homo sapiens
tgtaataaggatgcacaaacaaaagataattttctgcatctgtcactttcttgaggtaagctttgtatacattacgtatatccttttatactttctaaagaatgtgtttttcggatgtatgcatgacactatttttataatctttttaagtgctaaaatttgctgtttatttttgttagataaaagagtgaccatttcatttttttcttccgtctaattgtacttattgcagatgttgttaggatacaaaaatgttagaaaatttgcaaacagattaaggtaataaccagatataagtaaattttgagagagaagttcaattttgttgaaaagtaacttatgaggtgtaataaaagc

SEQ ID NO: 37199 - DNA, 403 bp, Homo sapiens
gagggggagtgggtgtgtgaggaagaaagaggggggctggatgcgatctccttgaaatgccaccccctctctcaatacacaattatctcttattacttggcatttcctcttaaaacgggtgtggaacattacactaggcagaaattcaaaaatgattaagaaggatgttgagcctgaaagtataattatcctgattaaatcattaccatcctcattaataccaccaatctctaaataccattgcaggatgctgattccatgttttgaaattcaaattgctcagctgcctttaaattttatttttaatactaccttctccctcaccccccccaacaaaaaaaaatccaacaacacaaattctgcccatcagttaaagtttactttcacggcaaacatgcccaca

SEQ ID NO: 37200 - DNA, 485 bp, Homo sapiens
  misc_feature 1: n = A,T,C or G
ngggaattcggccttagggccgggatatatctctactgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagaagtgtgaccaaaagttacatgtttgcacctttctagttgaaaataaaggtatttttttttt

SEQ ID NO: 37201 - DNA, 463 bp, Homo sapiens
gaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgctagt

SEQ ID NO: 37202 - DNA, 404 bp, Homo sapiens
atttgaaaatactgcagattttcatttactgctgctttctatgtagtatattgttcagttctaagaatttaagattttttcattgtgatattttttcttcccctaagagatttgtagaaagtggtctagttccaatgtggaaggttttgtgagttatccttttgttactgatttctaatttgcactgtagttagcatacgtgtcaaggccaacaattctttgaaattcgagaattgctttatggttttaactgctccttgtatcatcaagaataatttgtactcacagacttttgaggcaatgtatgtaggtgtgtgtatatatataatatatacacatacactttatatatagattatatataatctctctgtagagtttatataaaaattaaatatatttat

SEQ ID NO: 37203 - DNA, 232 bp, Homo sapiens
ggcaacggcgggcagatcactgtagctcgggagtttgagaccagcgtggccaacatggcgaaaccccatctctactaaaaatacaaaaattagctgggtgtggtggcaggttcctgtaatcccagctactcaggaggctgaggcaggagaatcgcttgaacctggaaggttgcagtgagcagagatcgcgccactgcactcctgccttgggtgacagagcaagactccatct

SEQ ID NO: 37204 - DNA, 245 bp, Homo sapiens
gacgtggttcacgtgaaagatgccaatggcaacagctttgccactcgactttccaacatttttgctattggcaagggcaacaaaccatggatttctcttccccgaggaaagggtatccgcctcaccattgctgaagagagagacaaaagactggcggccaaacagagcagtgggtgaaatgggtcccttgggtgacatgtcagatctttgtacgtaattaaaaatattgtggcaggattaatagc

SEQ ID NO: 37205 - DNA, 373 bp, Homo sapiens
ggtgtaaaaggctgaggtaagaggattgctagagcccaggacttattaagagtccagcctgggcaacataggtgagaccccctcatctgtaaaaaaggaaaaaaaaatttgtatatataaataacttaattgctctcttagttgggaatttaagtgattaaagagttaagtttgcatatgttagtaaggtattaagctggatattaaaaaataaattatctatggatggtagagattgactggaaagaataggagtttcttcaggtgatagaaatgtttcctatcctgattgttggttacacagatatatatatttgtcaaaactcgttgaattgatactatctttgcgtttcaccatatctaaattttacca

SEQ ID NO: 37206 - DNA, 460 bp, Homo sapiens
ggcatgcgctgtggctaatgccgtaggctctttcagggctgagccatcctgcgtgtcttgcgctcggtggaaatgcccagccgaggggcgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatactgtctgagagcaagaatatattgggatgaactgaaaaaagaataccaagaaatagaaaacttagacaagaccaaaatcaagaaatagtcaaccctgatttcacataacaatgtgtggcatttgttgttctgtaaacttttctgctgagcatttcagtcaagatttaaaagaggacttactata

SEQ ID NO: 37207 - DNA, 473 bp, Homo sapiens
  misc_feature 454: n = A,T,C or G
cttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaaaatatcttatgtagaaatattttgataatatttttacagtgagctttcccatgtttttatgtcttaagtttctttgctgcgtttatgtaggttgcacaagaacttctactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaataggaagtttacagacaattctgatgattatgatttcattttggnttaactaagctgtactagt

SEQ ID NO: 37208 - DNA, 434 bp, Homo sapiens
  misc_feature 385, 397: n = A,T,C or G
aagatcacttgatatcaggagtcgaggcgggaagatcacttgacgtcaggagttcgagactggcccggccaacatggtgaaaccgcatctccactaaaaatacaaaaattagcctggtatggtggtgggcacctgtaatctcagcactctgggaggccgaggcgggaagatcacttgatatcaggagtcgaggcgggaagatcacttgacgtcaggagttcgagactggcccggccaacatggtgaaaccgcatctccactaaaaatacaaaaaatagcctggtattggtgggtgggcaccctgtaatcccagtgacttgggaggctaaggcaggagaatttcttgaacccaggaggcaggaggttgcagtgaccagcaaggttncgcattttgcancccccagcctgggcgataagagtgaaaactccatcct

SEQ ID NO: 37209 - DNA, 124 bp, Homo sapiens
  misc_feature 7, 11, 30, 97: n = A,T,C or G
ctccccngggnaattcggccatctatggcncggggttggacatttccatctataaaactttaatttttggaattgttttatggcatttattaaactngtgggattttattatttggtatttggg

SEQ ID NO: 37210 - DNA, 469 bp, Homo sapiens
gctgaggggggtggatcacttgagcctaggagtttgagatcagcctggccaacatggggaaatcccatttctacaaaaaatttaaaaattagcaagatgtgatggggcttacctgtagttccagctacttgggaggctgaggtaggaagattgcttggccctagtaggttgaggctatagtgagcagtcatcaggccactgtactccagcctgggcaacagtgtgagaccctgtctcaaaaaataataagtctctttgggaggctgaggtgggtggatctcttgaggtcaggtgttcgagaccagactgtgcaacatggcaaaactccatctgtacaaaaaatacaaaaattagttgggtgtgggtggcattgtgccccagctacttggaaggctagggtgggaaggattgcttgagccccagaaggtggaagttgcagtgagctgagattgtgccattgcactccagc

SEQ ID NO: 37211 - DNA, 407 bp, Homo sapiens
  misc_feature 391: n = A,T,C or G
ggattccactcctcaggagcttatagtccaagcgagagaatatgtgtatacataaagccttaatacaaaatagaagattataaatgatagtgtaaaacagtatactgtaggagtcacacacctatatacacatatttttcaattctctcttcttatatcatttgggtgtaaaaaaaaaataaatatatcacttagactgggttctaattgatggcctgcaggaaccaggatcctgttgtatttcttcagtaaaaaacaaatattggtaaatttaaaacaatgatagaggctaggcacagtggcttgtgccttgtaatcccagcactttgggaggctgaagagggaggatcgtttgaagccaagaattcaaaaccaacctgggcaacaaagngagatccagtctctgt

SEQ ID NO: 37212 - DNA, 136 bp, Homo sapiens
  misc_feature 7, 8, 28, 29, 54, 60, 67, 68, 77: n = A,T,C or G
ctcggcnntttatggcccgggagaaaanntggtaaaaaaaggaaaagcatttantcctancctttcnnttacaaccnaaatgtcctggtaatcagagagttgataatacaaagttctttgtagaagaaattttagc

SEQ ID NO: 37213 - DNA, 451 bp, Homo sapiens
  misc_feature 445: n = A,T,C or G
gaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaaacctttcctttagaagccagatgttggccatgaatattgagaagaaacttaatcagaatagcaggtcagaggctcctaactgggcaactcaagattctggcttctactgaagaaccataaagaaaagatgaaaaaaaaaactntcaaag

SEQ ID NO: 37214 - DNA, 467 bp, Homo sapiens
ctttttctcttgttaatgtttcttgaaagtccttctgagttaggcagtgtggcaagttgatactttttaatgctatgaatgtataattttctagattttttgctatttcaaacaatgctgtagtaaaatctttgtaaaaatatccttatttaccagggcttttatttatatgggctcttgctgctggatgaaaaagtatttttttaataatagatttttccagattgctcttttcaaaggctgttaataattcagatttcaccaggagaacatgaaggagcctcttccctccatctccactagcaataggtgctgttactctatttttttttaatgtttttgccaatctggatttggatttgctacattgtacatttccaatttcatatcctttctgtttttttcagttgtgcttctttccaaacccttttcaccatcattacaaatgttttaaagatataattttt

SEQ ID NO: 37215 - DNA, 460 bp, Homo sapiens
gtgattttttaaaacctgtctttttgttttttgagacggggtctctatcactgaggctggagcacagtggcacaatctcagttcactgcaacctctgcctccctggttcaagcaatctttccacctcagcctcccgtgtagctgggaccacaggcacgcgctaccacgcccggctaattttttttgtatttttagtagagactgggtttcaccatgttccctaggccgataaacctgttttattatctttatttatcagccatttgaaggtagaaactctgttctattccttcttgaattcttatagctgctgcgttggttgtctttagtattttccattaattttaataccattttctgtcattttcaaatagctattaagtttccaaaagtaattgtttttttctgagaagacaaaaaccaaagggaatcatgcttggattttggaaaatatctctct

SEQ ID NO: 37216 - DNA, 100 bp, Homo sapiens
gttccctgactgcgtgaaatgttcagggaggtcagttgatttccccaggtacattcatggtgtgacagacacatgggtacaaataaaagacccagaaaac

SEQ ID NO: 37217 - DNA, 442 bp, Homo sapiens
ggagctcaaggataatgacaatgtatatagcctgagcatctgaaatgattggcatgcaatttactgagatggggaagacaagactaaagaagggaaaagcaaattttcaaaaggaagggagaaatcaaaagtttaatctgagaagtagtcagttattcaaagtggggcctgtcgtggtggcttacgcctgtaatccaagcacttcaggaggctgaggtggccggatcacttgaggtcagaagttctagaccagcctggccaacatggtgaaaacccaactctactaaaaacaaaaattagccgggcatggtgtgtgtgccttgtagtcccggctactcagtaggctgaggcaggagaatagcttcaacctgtgaggcagaggctgcaatgcactgaggtcatgccactgcactccagcctgggtgacaaaacaagattccat

SEQ ID NO: 37218 - DNA, 226 bp, Homo sapiens
  misc_feature 26, 28, 39, 44, 49, 52, 55, 65, 91, 97, 107, 127, 148, 174,193, 219, 221: n = A,T,C or G
gtgatttgaaggggtttttttttttntngatagcggggnccttnggggnggnctnggggctcaanagtagggctagtagggattacagggncagctntcccaccctnaggaggcccatttttaatanacggggaagttgaggcccagngcgggggctcacacctgtaatcccancacaggagtttgaaaccancctgggcagcatggggaaaccccatntntttgg

SEQ ID NO: 37219 - DNA, 305 bp, Homo sapiens
atagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 37220 - DNA, 307 bp, Homo sapiens
  misc_feature 45: n = A,T,C or G
ctggcgtcaccatagtacaccacaatgcgtggaggccgacttggngttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttca

SEQ ID NO: 37221 - DNA, 126 bp, Homo sapiens
atctgttgcttttctcaatgattcagggatacaaatgggcttctctcattcttaaaagaaaacgcgacatctttctaagattctctgtgggaaaatgactgtcaataaaatgcgggtttctgggcc

SEQ ID NO: 37222 - DNA, 249 bp, Homo sapiens
ctctcaagaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaagggagaagagatcatttg

SEQ ID NO: 37223 - DNA, 418 bp, Homo sapiens
ataattttgtgttataaaatatgccttataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacac

SEQ ID NO: 37224 - DNA, 280 bp, Homo sapiens
ggaaaactggagacagaagtacgggaagacgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatag

SEQ ID NO: 37225 - DNA, 154 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcg

SEQ ID NO: 37226 - DNA, 428 bp, Homo sapiens
  misc_feature 426: n = A,T,C or G
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtggcccgagtgtaacaaccatataataaatcacctcttccgctgttttagctgaagaattaantc

SEQ ID NO: 37227 - DNA, 331 bp, Homo sapiens
accggggctggagcggagtgaagctgtctgctgtaagaggagtggccatgtgagggcatggagtcattagtctcacaaacacattttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgc

SEQ ID NO: 37228 - DNA, 384 bp, Homo sapiens
  misc_feature 14: n = A,T,C or G
gtgccaccctgaangtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaagc

SEQ ID NO: 37229 - DNA, 472 bp, Homo sapiens
tcagagaggtagcaactaggtaaactccttataaaaagcaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttattttttt

SEQ ID NO: 37230 - DNA, 189 bp, Homo sapiens
  misc_feature 186, 189: n = A,T,C or G
catttctttgcttcttcccataatttaaaaaaaatggggggagggagaacttaatatatgtggaaaataagttattatcaatgaaagaaaatattaggcaaagcataatttcaaaattactaagattgtaattatcttacacccttcttcctctttatgacagttatgtgaaagttgggtgggcangtn

SEQ ID NO: 37231 - DNA, 201 bp, Homo sapiens
gactgaagtagaagaatcttgcaaggaaaggtgagagaaaaggccagagaagtggtcatggtgcaaggcttctttcccaggatcacctctcagagctagatgctctttaccccaatgggtcacactagtatttcagccttctgggtggggattgtttcggggacattttaagttcaatccaaattaggcacttggggattg

SEQ ID NO: 37232 - DNA, 356 bp, Homo sapiens
gggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggcagcccagagcttccctagccttccccagaactgctgtgtcagggatttgccccctgtccggctgggaagactttcctcatttaagggtaggttttggggaactggcctccttttgttcctgtacccccaatcactacctgtccagtcttctgtcctgtcccagactcaggtggggctgggcagctttttcatataaaaccctcatccca

SEQ ID NO: 37233 - DNA, 476 bp, Homo sapiens
atacatcacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagtccttccacagttcagcaaacaagtgctagcttcactgaccaaaaattaaggaaggaaaacacagtttttaaaacgatccagctt

SEQ ID NO: 37234 - DNA, 373 bp, Homo sapiens
ataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatg

SEQ ID NO: 37235 - DNA, 468 bp, Homo sapiens
caagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccacctgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagata

SEQ ID NO: 37236 - DNA, 200 bp, Homo sapiens
gaatccagcctcacattatcttagtgattgagtttgtgataacccctatattgccataaggtaagaaacctgaaccaaggccttgggtatcagattggctggataaggagggatgagcacagaaggaaggacaaagataatacctttttcaagatgagcctgtaaatgaaaattctaaaataaatgctaagaaggccacc

SEQ ID NO: 37237 - DNA, 430 bp, Homo sapiens
  misc_feature 8, 48: n = A,T,C or G
aaattagnaaaaattccgttattttttaatagtaatttaccacacagnagttaggttacaaagaaatagaaacataccatagttaataaaggtaacagggttttgtagtatataaaatacagctttacatatgaatccattataggaaacttcctttggttgcatgtgtatgtaggaaggcagataggtagaaaggtaaatgaattattggacgacccctccttttcagtgggcctcaaaaatagcaagctaaagcagaaattaatattaccatattttatgaaggcttgggggaacaaagtaaggtttcaagcatagcattagcattagttccaaaggctgttgtttttaccttttaaaagtcctgttttgaacatattttaatgacagaaaatttgaaaactcccactaacaacaccaaaagatactg

SEQ ID NO: 37238 - DNA, 226 bp, Homo sapiens; identical to SEQ ID NO: 14144

SEQ ID NO: 37239 - DNA, 424 bp, Homo sapiens
  misc_feature 9, 10, 12, 30, 32, 51, 55, 56, 58, 61, 69, 72, 108: n = A,T,C or G
ggcagcacnngngggagaatggagtaactngntctattatagatgaattangcannantgnagactggnctngacttgtggtattcccccatgctatcctaggactgnattgctcaattttaggaagcctttactactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccacaagctttcatgttgggcaaggaaaagttgaggaaggatggctgatggtgatggaaagctgtgttaatggtatgaggaatgtgtgaaaagtatacac

SEQ ID NO: 37240 - DNA, 482 bp, Homo sapiens
  misc_feature 84: n = A,T,C or G
gggggcctgtgacccggaggcgttggggctgtcctgggtcgtcacatgcaagaaatcgtctcaccccagccagtgtgacggagngagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtgaccccacgttatcaagaaaagtacaggaaatccgccgttgggagagcggcagcacccatgtggagtgccacttttctgatctgggacttaaacaacattgctgttttcctccttgctccaagtcatccattttgacaattttatatcagcatggacccttcaccaagactgaaataactctgttattgagtgttgggaacacggagatgaataaaacaaggcccctgtc

SEQ ID NO: 37241 - DNA, 467 bp, Homo sapiens
ggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgag

SEQ ID NO: 37242 - DNA, 257 bp, Homo sapiens
gacacgcttttcatctgtcccgctgcgtgttttcctcttgatcgggaactcctgcttctccttgcctcgaaatggaccccaactgctcctgctcgcctgttggttcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagcttgctgtgcctt

SEQ ID NO: 37243 - DNA, 473 bp, Homo sapiens
  misc_feature 12: n = A,T,C or G
ggcatgatcttnagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaattttttttgtctttaaatagatacaaatgtctatcaactttaatcaagttgtaacttatattgaagacaatttgatacata

SEQ ID NO: 37244 - DNA, 440 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatggtggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatga

SEQ ID NO: 37245 - DNA, 353 bp, Homo sapiens
atatagattttggagcagataatactgcaagaagaatgatgctataaatttattatctcaaaaccctgccaagagtcaaaatagataaaaatgtgcaaacagcactaataagagcatacagtttcctggaaacatctgtccttgctgacaaataaacatctttttaataccctaaaaagctaatttaaaggaaaataatgagggatggatgctggaggtaaaaaggactagagctgtgctgtccaatgcaatgtgattgaccatacatggctattgattacttaaaatgtggctagtccaaataaatatgtgccgtgagtgtaaaatacacactggatcccaaagactcagta

SEQ ID NO: 37246 - DNA, 473 bp, Homo sapiens
aaggacattggcatttgacctgaattatggtgttttattgaatgagctataagacaacatttttaccctttaaaatgaacactgaacaaatgtgttaatggtatctttgttaaaaggaaaacatagctataaataaaatactacatcgaaatccagcactggagttcatttgaaatttgatattttgtgtaaaataacaaacctattaacacagatttttaaaataactcagaatcgtataaagcactttggtacttatttgttctcttttcccttacattctgtgtggtaggtggtattatctctgatttacacatgaagacatccttgttaatgcaatttatttattcattcgggcatttactgtgtgccaacttgcaaaaggaatagaaatgtctgtgatctagatagttctagattgaacatagattttctgccaacaaatcctctctgctgttcacattatcctttgt

SEQ ID NO: 37247 - DNA, 104 bp, Homo sapiens
gggcgcaggaactgtgtgtgtcctacacaatggtgctattctgtgtcaaacacctctgtattttttaaaacatcaattgatattaaaaatgaaaagattattgg

SEQ ID NO: 37248 - DNA, 210 bp, Homo sapiens
  misc_feature 4, 45, 90, 134, 147, 179: n = A,T,C or G
cccngggaattcggccttctggccgggatcctggattggcttatngaggaggctgaaggccggatgaggggccccccagttgttttgggnaagccccttcaggaagaaccagcaaaaagacagttccaacgagnacttacccggagnatgctgtttccggaagaagttcatgttttgcntcgatataaagaactcgatttaagaaaggga

SEQ ID NO: 37249 - DNA, 191 bp, Homo sapiens
gtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgac

SEQ ID NO: 37250 - DNA, 466 bp, Homo sapiens
ctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagttgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagt

SEQ ID NO: 37251 - DNA, 147 bp, Homo sapiens
attctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatat

SEQ ID NO: 37252 - DNA, 477 bp, Homo sapiens
aaggaagctgtcactcatctgatccagccattcgcaccgtatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttac

SEQ ID NO: 37253 - DNA, 303 bp, Homo sapiens
gggactttgaacaagttgcctaccatcagtgcctgtttacttgtctgtgaaaccgaaatgttaaagagtatctatctcatagaattgtgatgaaaattaaatgtcaatttaatgctcatatatggaacactgcatggcacataaaaagtactttatcagggttggctattatataaaatatggggtagcacagagaatgaaacaactagttaaatttttggagaatcaggaaagcttcttaggagttggtatatgaattgtgttttaaagaagtctaggagttcataaaagtcaaagggcagc

SEQ ID NO: 37254 - DNA, 248 bp, Homo sapiens
atataacttcattaaagaattatcacctttctttgtcattgttataatattttcttccaaagcccagaagctgtgctgtgttatatattccttggaaactttcaaatgccaatggagtgaccagaatgttctttgtgccatgacatgtactgtctgcaaagctaatctctttcctactggggaatatgtttaacaggaactggttatagctagactgaaaatcaatcaccaaggccactgatgatgcc

SEQ ID NO: 37255 - DNA, 225 bp, Homo sapiens
ctcccaacccggcctcctgagtagctgggactacgggagcacaccaccacacctggctaggtttttttttctcgtagagatggggtttctctatgttgctcaggctggtctctaactcctaggctgaggcgggagagtcgcttgaacctggggaggcggaggttgctgtgagcctagattgtgccattgcactccggcctgggcaacaagagcaaaactccgtcc

SEQ ID NO: 37256 - DNA, 467 bp, Homo sapiens
cttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaac

SEQ ID NO: 37257 - DNA, 463 bp, Homo sapiens
ggccctggggtggaaacacactcgatgtgttcaagggagagtaagtggtgaatgggtttggagccaacagggataatagacaacgctatcaagaggggggccaaccacacatgtgcagccactgtatgacgtctggattttccttgacttatggtgatcactattgggaggtggtaagcaaacaggtgacataatttgaatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcatgtacacaccctgact

SEQ ID NO: 37258 - DNA, 128 bp, Homo sapiens
cagtaatgtaaactttattttctctcaattttcgtaagtggtattttggtgctttacccaaaatattagggagaaaattcttctttttaactggattctcgtatgttgatctatttctattgttttct

SEQ ID NO: 37259 - DNA, 466 bp, Homo sapiens
  misc_feature 440: n = A,T,C or G
ggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtgggagttggtgaatcggttgctctttcctcacatttggatgattgtcataaggnttttagcatgttcctccttttcttca

SEQ ID NO: 37260 - DNA, 472 bp, Homo sapiens
  misc_feature 30, 72: n = A,T,C or G
gcttgtgtatcttgaaatagccgccttttnagttattataccagaacctcttcacatagacctattagtgcntttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatccgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttat

SEQ ID NO: 37261 - DNA, 464 bp, Homo sapiens
aacactggctaattcgaaatcgctcctcagacttagattccaagagtatcaaagagattagatgggaggctgggccaggaacccttgttttaatgtatttgtccataattaacactggtgaccatataaggaacaaagtatatctgcacatttcactgagacatctacattggaaaacccaaacaaaaagaagcaattcaaataaaaagacaacataagaacgaaaataagttggtcacattaacactggaagccatctttaagtgagtgctgtcatattgtgtcacagtaatttttagccaaatatggcatttgtaaatttaaactttctctcatggaaagggggctggtacctgtcaaagtgttattttatgcaacaatatagtcactttttattttggcaattagaagtagactcaaaggagattacaatttggttgctggcagccattctgggtttcttg

SEQ ID NO: 37262 - DNA, 477 bp, Homo sapiens
gaggagtacatcgtctagtgagggacagaccaagcacgcaaaacaaattgcaataatgtgataagttctttaaaagaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcct

SEQ ID NO: 37263 - DNA, 149 bp, Homo sapiens
gcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcgg

SEQ ID NO: 37264 - DNA, 271 bp, Homo sapiens
ggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtggaagtcctcatactgagaaatttgtatattttatattaaatcacttactattg

SEQ ID NO: 37265 - DNA, 467 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtat

SEQ ID NO: 37266 - DNA, 161 bp, Homo sapiens
gctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttc

SEQ ID NO: 37267 - DNA, 237 bp, Homo sapiens
gggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 37268 - DNA, 254 bp, Homo sapiens
attcatgaagcacctacgatggttcaggcacaaacactgaaacctcaaattggccctggcagaaggggaccatcatagcaaggtggggggggcggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagac

SEQ ID NO: 37269 - DNA, 186 bp, Homo sapiens
agattaatgagacagaaaattaacaagggtattcaggagtcgaactcagctctggaccaagcggacctaactccaccccatctacagaactctccactccaaatcaacagaatatacatttttctcagcaccacatcgcacttattctaaaattgaccacataattggaagtaaaacactcctcag

SEQ ID NO: 37270 - DNA, 465 bp, Homo sapiens
agagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctg

SEQ ID NO: 37271 - DNA, 210 bp, Homo sapiens
atatataacaaacccactgctaacatcatactgaacaagggaaaaagactagaatgctgactttcaccagtcctattcaacatagtactgaaagtcctagccagtacaattagccaaaagaaagaaataaaagccatctaatttggaaaggaggaagtcaaattgttcctgcttgcggataacataatcttacatatagaaaactgatga

SEQ ID NO: 37272 - DNA, 218 bp, Homo sapiens
  misc_feature 20: n = A,T,C or G
gcaaagttagatgccaaagnagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgtt

SEQ ID NO: 37273 - DNA, 469 bp, Homo sapiens
cttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggtttgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagc

SEQ ID NO: 37274 - DNA, 468 bp, Homo sapiens
attgttccataacttacacttgaggcaatctgttcagtgtgtaaccactttataaaaaataacttaccattgataacctggaaggtggactacttgtaagtagctggtgtttattgattaaaccatggaagttttcatgatacccaagcatgttgctgaaactgatgcatttgaaagagctgttgaaataatgcaaaactttggttttataagaatctactcatgttttaaaagtatttaactctgtagaccacaattatagaaagctcagtaatgctgctaatgacatttgtaaactatatctgtaatgtagtgcaatatttttatatttcactgggagaggcggtagagacaccatagttgtactttagtgcaagtgggggaacactccaaatagcctagagtatagtaaggtacaaagcttcaatgaaaaaagctgtattatattacattactgatgtaatcttg

SEQ ID NO: 37275 - DNA, 339 bp, Homo sapiens
atttctttaggattaataattttaaaattttggaagacagggactatatttagattggtatatggggtcatattcagtgtatatcagtatattcttttgttttgtttttttttgagacagggtctcactcttgtccccaggctagagggcagttgcatgattgtagctctctgatcttcaatcaggcatttcttttctgctgatgaaaatctgaaaagatacattgactaatcattggaaatcattaagcagaacctgagatgtttttgaagcagagaaggacatttagttcaaagatttattgcatatataggtatgtaccaggacaacttgttaagc

SEQ ID NO: 37276 - DNA, 341 bp, Homo sapiens
gaaccaagcataatatagcaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 37277 - DNA, 102 bp, Homo sapiens
caatattcaaatttgaaaagttttttcttttaaaggatataaaatcattaatttgagtaatttttattaccattactaaaaggaaaacatgtgctatgtgat

SEQ ID NO: 37278 - DNA, 137 bp, Homo sapiens
gaacacagtgccatatgaataatttcacatacagaacctttttttctctgaagtcctgtggacttgcaaatatatatatatattgctttgttaatttgtttttatatttcatatatgtaataaaggaatatgatctg

SEQ ID NO: 37279 - DNA, 466 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggagaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 37280 - DNA, 466 bp, Homo sapiens
  misc_feature 435: n = A,T,C or G
aggaagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcacccttgggagtttcctgangggttttctcataaatgagggctgcacattg

SEQ ID NO: 37281 - DNA, 465 bp, Homo sapiens
  misc_feature 22: n = A,T,C or G
ggaattcacatgttaacaaagncttcgcaagtgactctgtcacataaccaggatcaaaaccccctttcttgatcagatactgaatcatctccctcttatggcaatattagaaataattatagatgtcttcccccaacttacagtctgtaaactctttgaggacagatttacatttgatttaccttggtcagcttcctggcacctagcaaggtccctcatagattatgtgtcttagaaactaaagaaccaggaaaataccttttgttaactttattcagaaaaaaagaactgccaggcacagtaatcccagcactttgggaggccgaggtgggcatatcaattgaggtcgggagttcaggaccagcctggccaacatggtgaaacccagtctctgctgagaatacaaaaattagctgtgcatggtggtgcatgcctgtagtcccggcaactcgggaggctggggca

SEQ ID NO: 37282 - DNA, 341 bp, Homo sapiens
  misc_feature 205: n = A,T,C or G
gtagatcagaggtccgtctaccttgggggcatcagagagatgccatttttgtaaagaacatttcaaatgaatgaggaatgtggggtatcagaacccttgaagagggtgaggggagggagggcttccttcaatgcagcctttctcttatgacttatatcagtaacagcccagcatcaggactaggtgcacttgtggtgtttcacangaaaatattcaccacaagagcatgttcaaagcagccttagatcttttcttttgttcgtttgtaaagtggtttttgagcatttctcgtcaagtttcttgaaaagtgctttgaccaacacctgaggcttagaattgac

SEQ ID NO: 37283 - DNA, 467 bp, Homo sapiens
ggggagaagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagct

SEQ ID NO: 37284 - DNA, 243 bp, Homo sapiens
gctttcagggagcctgcgtgagttaagcctctccttgtagtgatttcccgatgcccagcaaggccgaagctctcatttcctttaggagtgttgttttttttttctcaatgaaggatgaattttctaaatccataattacacctgaccatgatggcagcttctctgttaagggcttggaaagtaccttgttaattacttgacttattttgtcaacattttttcatgttctccccaccccttgtg

SEQ ID NO: 37285 - DNA, 456 bp, Homo sapiens
  misc_feature 416, 435: n = A,T,C or G
gggtgggtgcctgtaatcttagctacttggggggctgaggcagaaggatcactggagcctaggaggtcgaggctgcagtgagcagagattatgccactgcactccagcctgggtgacaaagtgagaccctgtctcaaaaaaaaagaaagaaaactccttggagaaagataacatctcatagacataaaattatttctatatattttttcaaatgtagtatctggcatataatgaggcacacaagaaccaagacaacataaatgataaccagcaaaaataaggcaataaagcaatagagataaacagaatctctagacactgaaattgtcagatatatttttactatgatcaaaagagataaaacagactgagaatttatgggcagagaactaggaagcctgacttttttttttganactgcactccagcctgggngacaaagtgagaccctgtctc

SEQ ID NO: 37286 - DNA, 139 bp, Homo sapiens
gcaatatcaaccttaaccttccctctacacttatcatcttcacaattctaattctactgactatcctagaaatcgctgtcgccttaatccaagcctacgttttcacacttctagtaagcctctacctgcacgacaacac

SEQ ID NO: 37287 - DNA, 466 bp, Homo sapiens
aaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatcct

SEQ ID NO: 37288 - DNA, 250 bp, Homo sapiens
ggagaggtccacatggcaaggaactgaggcctcctgccagtagccagcaccatcttgctggccatgtgagcgtgccatcttagatgcagatcatacggccccagtcaagccttcaaatgactgcatccctacttgacattttgactgtaacctcatgagaaaccctaagccagaacaccagctaagccactccccaattcctcatcaagagaaactgagataataaatgtttattattgttttaagctac

SEQ ID NO: 37289 - DNA, 468 bp, Homo sapiens
tcccctttaatatatatctatcctattagttctgtccctctagggaaccctgactaatacaccaattttttttgaaatgttttttatgagttttctgcttttgctatctgatctctctctggttttatctgggggttttggaagacccaaaatgatgactggaatcaatttttcagcatactcatatatttatttaattagtactaaattttcaactaaaattaaatttaaactaatttttttaatttaacagaatttaatttgagaaggaatgattcatgaattgggcagtctcccgagccagagtaggctcagagccatatggtggaagaagatttatggatagaaacaaggaaaggaaaggaaagaaaatggaagtgacgtacagaaacaagtgaccaaaacttagggccttagtgccactctcagttaatatcatttggggtttctggtcacagcacatcattt

SEQ ID NO: 37290 - DNA, 471 bp, Homo sapiens
  misc_feature 469: n = A,T,C or G
tatgggatattgatttcttgtctttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaaaatatcttatgtagaaatattttgataatatttttacagtgagctttcccatgtttttatgtcttaagtttctttgctgcgtttatgcaggttgcacaagaacttttactcacttgtaattgtgcctcagactttttgaaagtctaccttctaaattgccccgacgatctagattctacatgttaccattggtttattcttgtgctttctgtatttaaaactttggctgtgctaagcaaatgcaaggttataatttagctaatagtagtttacagacaattctgatgattatgatttcatttggntt

SEQ ID NO: 37291 - DNA, 465 bp, Homo sapiens
cgggagcctgaggcaggagaatctcttgaacctgggaggcggaggttgcagggagctgagattgcaccactgcactccagcctggacagtagagtgagactctgtctaaacaaacaacaaaaaaaaactctgttttggacacatgactttagggagataaacataactctgggattttattttttaatatgctcctgaaaacagtcaactctcccatttcctagctgggagaagtatgtctcacttaattttgctcattcaggagaggatgaatttttcagcaatgatagtaatagctggctgttgcaactcatttcttgctgcagcgtagcacatccaccaagaatgccctttcaccttcctttgtcttgccaactccctcttagctttcagtaagacttggctcaaactgcatcctccaggaagcctatgttaactcctaactgccactcttggatccagggt

SEQ ID NO: 37292 - DNA, 449 bp, Homo sapiens
  misc_feature 13: n = A,T,C or G
cttgtcaaccagnattgagttgctatagcttgatgcagggacccagtgaagtttctccgctaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggttattttaagtgactttttatg

SEQ ID NO: 37293 - DNA, 466 bp, Homo sapiens
  misc_feature 9, 43: n = A,T,C or G
acctcaagnaatagcagaagccatgctccaaaccaccaccagnacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccaactcgcagaattactgaagtttggggtattccttcccccattgatactgtttttactaggtgcaactgtgaaggaaaaactttcttctttaaggattctcagtactggcgttt

SEQ ID NO: 37294 - DNA, 398 bp, Homo sapiens
gtagagtttctgtttaacatgatgaaaaagttttgtgacgagatagtggtgatgattgcatgatattgtgaatgtacccagtgccactgaattgtacacttaaaaatggttaaaatgaggccaggcatggtggctcacgtctataatcccagcactttgggaggctgaggcaagtggatcgaggtcaggagttcgagaccagcctggccaacatggtgagaccctgtctctattaaaaatacaaaaaactagccgggtgtggtggtgagtgcctgtaatcccagctactcgggaggctgaggcaggagaatcacttgaacccgggagacggaggttgcagtgagccgagatcacgccattgcattccagcctgggcaacaagagtgaaactctgtcac

SEQ ID NO: 37295 - DNA, 249 bp, Homo sapiens
  misc_feature 8, 22, 70, 71: n = A,T,C or G
agtcaagnaaaggcaaaccagnactcagaaaaaaggtacatccagcagtggtcattcgacaacgaaagtnntaccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 37296 - DNA, 490 bp, Homo sapiens
  misc_feature 18: n = A,T,C or G
ggtatataaaaacccagnatgtggagttcatgaggtgtccttggttacttaggattccaagaagtccgtttttaaattttttattttattttagattcaggggtacatgtgcatgtttgttacatggatgtgttacatactggtggtgattgggcttctggggtgcccattacccaaatagtgaacattgtgcccaacagataattcaaccctcaccctccttggttatttccaaccacctgttttgaccctggcttccaactccagaatcgtgatggatttacagaattttggggactgacgtgtttgctactggacaattgtagtgtgtttagtaataaaacagaaccagtatcataacaataacattacatattctgaatggactgaactattataattttgcctgaaactcatgacaactgcatatatttagtctgtgttcaagaattttattgctaattaccaaatagtacaaaatgaataattg

SEQ ID NO: 37297 - DNA, 469 bp, Homo sapiens
ggacaaaggtaagactatgtggagacatagagagaaaattgtcatctacaagccaaggagtgaggcctcagaaggaaccaaccctggtgacacattgatctcagacttctagcttccagttctcttgttcaagccacctagtctgtggtactttgttatggagcccgtagtaaactaatacagaagacaaaattccctgttgttccttaattcttccactataacttgtgtgtatttctttataattctatcttaaacaacatatttcttgattttgcctgtttataaactttacataaattgaacaatgctgtgtgtattctcctgtgacttgccttttcttttcaacgttctattcacatttatccatattgatgtgtgagctgtagcttatttgtattcactgctgtatggcattccattgtgtggatattccacaaattacctcttttacttgtgatggacattt

SEQ ID NO: 37298 - DNA, 111 bp, Homo sapiens
ggaaaaaataattattgggtactaggcttagtacctgggtggtgaaataatctgtacgacacacccccatgacaagaatttacctatgtaacaaacccgcacatgtgcccc

SEQ ID NO: 37299 - DNA, 220 bp, Homo sapiens
agcagtcatgatgttagactcattgaaaagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagt

SEQ ID NO: 37300 - DNA, 477 bp, Homo sapiens
ggaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaaagaagttgatgaaatgatcagggaagcagatattgatggtgat

SEQ ID NO: 37301 - DNA, 270 bp, Homo sapiens
  misc_feature 7, 81, 166, 181, 219: n = A,T,C or G
ggaaacngaccttaaaattgtaacctaccaacttacttacatgcttataaaagtaaaggagaataactggccgggcacggnggctcatgcctataaaattccagcactttgggaggccaaggcaggaggatcacttgagcctatgagttcaagaccagcctaggcnatgtagggacacctnatttctatttattttaaaaaaaagagagagtaactacngaagaactttaaaaaataaaaaataagcttaccttggattcttggcttaga

SEQ ID NO: 37302 - DNA, 218 bp, Homo sapiens
tccctcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttac

SEQ ID NO: 37303 - DNA, 308 bp, Homo sapiens
ggcggcggcgcgagttggactgtgaagaaattggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatga

SEQ ID NO: 37304 - DNA, 261 bp, Homo sapiens
  misc_feature 22: n = A,T,C or G
tacagccagaagagatatgagnaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctg

SEQ ID NO: 37305 - DNA, 420 bp, Homo sapiens
  misc_feature 3: n = A,T,C or G
atncaccgttgttattgtttacagaccatttatttaatatttcctctgtttattcctcctctccctcccattgcatggctcacacctgtaaaagaaaaaagaatcaaattgaatatatcttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttattgtgttgtataaaaaaattaacaatataatggcaataggtagagatacaacaaatgaatataacactataac

SEQ ID NO: 37306 - DNA, 205 bp, Homo sapiens
  misc_feature 23, 114: n = A,T,C or G
tagtggcaacattaaagttttanaaaatcatgctttgttagaaaaagaattacagctttgcaatataactaattgttttgcataattctgaatgtaatagatatgaataatcangcctgtgtttttaatgaacttatttgtattttcccaatcattttctctagtgtaatgtttgctgggataataaaaaaaattcaaatctttc

SEQ ID NO: 37307 - DNA, 212 bp, Homo sapiens
  misc_feature 6, 43, 76, 113, 138, 160: n = A,T,C or G
aaatanatgaccccttcagatcatctgtgcctacctcctgccnatcaggcgtctacactgtcactcagacacctgnggcactgtggaggagactgccctgtcctgagcctggnaaatgtgaaactgtctcctgcaacnctgctgggcactgtgggcctgnctgtgttcaattgcaagaacaatttttatgaaatggattaaagcttgttttt

SEQ ID NO: 37308 - DNA, 331 bp, Homo sapiens
  misc_feature 31, 32, 331: n = A,T,C or G
gatatccctctttgatcctttgttggaacanntggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcaggagaatctacaagaagaacaggttcacagaaggagatn

SEQ ID NO: 37309 - DNA, 426 bp, Homo sapiens
  misc_feature 2, 33, 34: n = A,T,C or G
gnacaccaagacctcacgcctccccatcattgnnttgcacccatggacataggagggcccgagcaggaattcggtgtggacatagggctggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctccct

SEQ ID NO: 37310 - DNA, 403 bp, Homo sapiens
tacatcttgggcggccagaaaaaccagagtgactgaacagtgtccctgaggagtaacgcgtgtattgtggaatactggatgtattgcagaatcccttccaggcaccttgcctttcctatgctgtccctgcgtctacagaatccttctgacttccttgctcacctgaaatgtgtctcctcctccaagattcacttcaaatcccctcctcggtgaaggagctgaaggagcgcgctaatcgccacccctccctcagcctgcctgagctactgccacagagaactcacacatctgcctggcaagagatccaacctgaattggagggtctgccctaggggacactgtccaagtcagggttgtccagggaacaggattacccaaagaacatttaaataacaatcccact

SEQ ID NO: 37311 - DNA, 337 bp, Homo sapiens
aaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagagggttaagctggctgtcctgaaatattataaggtggatgagaatg

SEQ ID NO: 37312 - DNA, 490 bp, Homo sapiens
  misc_feature 3, 6, 32, 34: n = A,T,C or G
aanttnccagctgatacaattcacatgctttntncttctgctgttggagaatatgtaacatgaaggaaaacttcctatgaagagagaataactttgatgacgtatgcctgataaagataaaacaaaaaattatggaccaattttacttatgagtatcaatataaaagtcctcaataagatattagggatcaggaattaaatactacattaagaaaggacatgaccaaatatgatttattataggttacaagggtagtccatgactgggcaacctattaatgcaattcactaaattaatagctacaaggagaaaaaagcatttacttccttccacagaagctgaaaagatctaacagaattcaatactcattcctcataaaaacattgaataagataggaattgatgggtgcctctttaacacaaaaaaatatatatatatctccattctagagacagtatcttacctaactgggaaaactccagtaagtc

SEQ ID NO: 37313 - DNA, 473 bp, Homo sapiens
  misc_feature 14, 18, 22, 44: n = A,T,C or G
tatggccgggtggngccntagnatatagtaccgcaagggaaagntgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctg

SEQ ID NO: 37314 - DNA, 196 bp, Homo sapiens
  misc_feature 21, 23, 48: n = A,T,C or G
acaattctattcatatataantntgtcataagcatgttttgtgagtgnaaaattctaatttgtaatgcatatcaagtgaaaagcctcagttcagcactcgtcatatccaaaatctgtgttatatgataatgtaaaagaaatattttcacacatgtagctcaaatgagattcttagttacatgtttcttttttttct

SEQ ID NO: 37315 - DNA, 116 bp, Homo sapiens
  misc_feature 3, 24, 113, 114: n = A,T,C or G
agnaagggaaagacagagagtgancaaaaaagaggagtcaggtcgctcctggggaagggagagagtgagactgggagaaagagaagcacagaaagtgtgtgtaaaacggggtnnag

SEQ ID NO: 37316 - DNA, 406 bp, Homo sapiens
  misc_feature 18, 23: n = A,T,C or G
tgccggtggagttcaagngcccngacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcgaccccagacactggtttgaagaatgttaagacttgacagtggaactacattagtacacagcaccagaatgtatattaaggtg

SEQ ID NO: 37317 - DNA, 413 bp, Homo sapiens
caaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtaagagaacatgcagttaggggtgcaaaaaatatcagggagtactcttccctgacttacttccttgatcatcctgatgtcctcaaactagtcaaaacttttcagattgttctccctatttctccagcttgagcaaatgagataagatgtt

SEQ ID NO: 37318 - DNA, 364 bp, Homo sapiens
  misc_feature 20, 22: n = A,T,C or G
tgagacgatcgtgaattcangnccgataagccttgaaggacttgccatagaccacatccgcagaacaatgtactggacggacagtgtcctggataagatagagagcgccctgctggatggctctgagcgcaaggtcctcttctacacagatctggtgaatccccgtgccatcgctggggatccaatccgaggcaacttgtactggacagactggaatagagaagctcctaaaattgaaacgtcatctttaggtggagaaaacagaagaattctgatcaatacagacattggattgcccaatggcttaacctttgaccctttctctaaactgctctgctgggcagatgcaggaaccaaaaaactg

SEQ ID NO: 37319 - DNA, 293 bp, Homo sapiens
  misc_feature 37, 40, 63, 91, 134, 167, 178, 195, 208, 238, 250: n = A,T,C or G
aatggagacagacatcagtgctgataaaaaaaaaaanggnccttaagaaactatttactctgnaatctctaataaaatatggaattccatnttagggcaatgagactgaaactactggggtttttctgccttgngaaaacaaacagttaaaacaagcctcaaatgtnttttagggccncccactggccataggtncaattcagttgtnggcttgttttgacttaattctaaaataggnctcaagcctgtntttttatgagtttattttttttaaaaccctgcatatatatgat

SEQ ID NO: 37320 - DNA, 228 bp, Homo sapiens
actgctatagcctaagcggctgttcactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacact

SEQ ID NO: 37321 - DNA, 131 bp, Homo sapiens
gatctcacaggctgagaactcgttcacctccaagcatttcatgaaaaagctgcttcttattaatcatacaaactctcaccatgatgtgaagagtttcacaaatctttcaaaataaaaagtaatgacttagt

SEQ ID NO: 37322 - DNA, 341 bp, Homo sapiens
gagggcgcaaacgagaaaaacccactaggagaaaaattagagctttaaaaacatctcgacagggtgcggtggctcacacctgtaatcccagcactttgggatgctgagacgtgtggatcgcctgaggtcaagggtttgaaaccaacctggacaacatggtgaaaccaccgtctcttctaaaaatacaaaatgagctagatgtggtggcgcatgcctgtaatcccagctacttgggagactgaggcaggagaatcaattgaacctgggaggcaaaggttccaataagccgagatcacaccactgcactccagcctgggatacaagagtgaaactgtgtcccg

SEQ ID NO: 37323 - DNA, 465 bp, Homo sapiens
  misc_feature 22, 23: n = A,T,C or G
cgtgttaaggatgtctctaggnnactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttg

SEQ ID NO: 37324 - DNA, 421 bp, Homo sapiens
  misc_feature 25: n = A,T,C or G
gtagaacacaactaaaaactcatgncttttttcacagaataatgtgccagttttttgtagcaatgatatttctcttggaagcagaaatgctttgtaccaggagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttacca

SEQ ID NO: 37325 - DNA, 440 bp, Homo sapiens
  misc_feature 18, 181: n = A,T,C or G
aggaaattttatcatagnatatgcccgatcaatctcatctcgtttaaattaaaagtttgtagtgcacaggcaaaaaccatagaggccatattcatggtcataaactgctctttctcatctctacctattttagcaataacattcttcttattagtttgttccaagtgaaaatgacataacngaatactttccctgctagtctgggaagaaaggatgtgtttgttggcttttgcctgtcagagagtattctgcaatgtttgcctagggcattgcttgcattcccatcagcatctctggtctgctgcactgtaatccctatagggacagcctctggcttttattactgacaagcagtgcactgtgcagccataggcaccataataggaaacaccttggcctgtcataaacaggtctggagagtagaaagtacaggcctgctg

SEQ ID NO: 37326 - DNA, 475 bp, Homo sapiens
  misc_feature 23, 24, 178, 365, 386, 446, 449, 465: n = A,T,C or G
agcttgctcctggtgggcatgtnngacgtttctgcatttggactgaaagtgctttccggaagttagatgaattgtacggcacttggcgtaaagccgcttccctcaagagtaactacaatcttcccatgcacaagatgattaatacagatctagcagaatcttgaaaagcccagagatncaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcgggcnctacaagccaaatcagatganaaggcggcggttgcaggcaagaagcctgtggtaggtaagaaaggaaagaaggctgctgtnggngttaagaagcaaaaanaagcctctgg

SEQ ID NO: 37327 - DNA, 492 bp, Homo sapiens
  misc_feature 18: n = A,T,C or G
ggactttgttataattcnttgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtataagtgtatgcctttccaagcttgccagtctttttggctttgaacactgcccatcagctacagtcattactgttccccaacccacaactatcttttaagaagtcttagttcacagtgaaaggaatgatgactttg

SEQ ID NO: 37328 - DNA, 418 bp, Homo sapiens
  misc_feature 25, 417: n = A,T,C or G
taactgagagcacttctggtcccangtatttcagatcaggggtactcaacctgtataacaattttagatacctagtacttagtgaagtagtatcaaaacatatcaagcaaaaattgatagtcgtgcagggagaaatggacagacttgccatcataatggaaggctgcagtacacttcttaattgttggcatatgaaataagtagcaagttagtaaatttaggagggatttgaacaatgtgattaacagactttaatgaattgatgtatataaaacactggaaccaacagtttgaaaataccagttttctccagggcacatggcgtgttttaaaaaaaattgtccaagcattagcatatgaagtgagtctcagcaaatgtcaatgactcagtgtcatagagaccactttttttttttng

SEQ ID NO: 37329 - DNA, 271 bp, Homo sapiens
cacatctgtaatcccagcacttcgggaggctgaggcgggtgtattacctgaagtcaggagttcgagaactgcctggccaacatggtgaaaccctgtctctactaaaaatggaagatttggccaggcatggtggcgcgtgcctgttgtctcagctactcgggaggctgaggcgggagaattgcttgaacctgggagtcagaggttgcagtgatccaagattgcgccactgcactctagcctgggggacagagtgagactccatctcaaaaac

SEQ ID NO: 37330 - DNA, 397 bp, Homo sapiens
tgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccacctgaggtgttgatgtggttttacgtcggagagattataggcaagcggggcatcattggctatgatgtttgaagaccaatctttaacatctgattatatttgatttat

SEQ ID NO: 37331 - DNA, 494 bp, Homo sapiens
  misc_feature 21, 451, 488: n = A,T,C or G
gcggttgatggcctaagactncaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggnagtagctccttctcagaattccgctatctcttcaagnggctgc

SEQ ID NO: 37332 - DNA, 300 bp, Homo sapiens
  misc_feature 23, 24: n = A,T,C or G
ctgtggtaacaaaacattaaccnnaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatc

SEQ ID NO: 37333 - DNA, 500 bp, Homo sapiens
  misc_feature 25: n = A,T,C or G
tgccgctaaatccaaggttgaaaanaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccactttcaaccaaatcgatatcagcaatgtaaaaatcccaaaacatcttactgatgcttacttcaagaagaagaagctgcggaagcccagacaccaggaaggtgagatcttcgacacagaaaaagagaaatatg

SEQ ID NO: 37334 - DNA, 445 bp, Homo sapiens
  misc_feature 7, 23, 137, 176: n = A,T,C or G
ctcaagnaaaatggtacaaaacncaaccgaggagcgtatacagttgaaaacatttttgttttgattggaaggcagattattttatattagtattaaaaatcaaaccctatgtttctttcagatgaatcttccaaagnggattatattaagcaggtattagatttaggaaaaccttnccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttgggggga

SEQ ID NO: 37335 - DNA, 151 bp, Homo sapiens
aaagaagaagctaaaacctccacgaggagggagggtaggagatagacttatagaaaaaataatattacatcttacatttgtatttgtacagttttcaacgtgctttgtttctcactgtttgaagtatgagctatttactatataaaccccg

SEQ ID NO: 37336 - DNA, 101 bp, Homo sapiens
  misc_feature 25: n = A,T,C or G
gactatggtaatcagtagacaatgncctgtgtatattaaatcatgttatataccttgaacatacactatttttatcaaatattaacattttatgacaattt

SEQ ID NO: 37337 - DNA, 386 bp, Homo sapiens
  misc_feature 19, 25, 225: n = A,T,C or G
ctggtggagtcaaataatngcatcnacatagtattgacatttttgaggagatgtaattattactggtatgaacacagagtggtgggcctgatataggaagaagacaaggtcactggagatgaggaggtaaaggaatttctaggaattgaatttccattgagtttctggttattggacaaagatgacaagagagtcagtggagagaagtacaataggcccgatgantccagtactcatggaaggagaaagagtgacaagaaaatcagcagaagatcacaacaagactggctccagaaggatggtagatgactgcaacatggcacgggagtagagtccaatggcaaatgtttcaatggaacagggcatttttagggatgtggaagaac

SEQ ID NO: 37338 - DNA, 439 bp, Homo sapiens
  misc_feature 2, 25: n = A,T,C or G
gnctattaacatcacggagctgacnctgccgcagctagaaatgctcaagaaccagctggaccaggaagtggagttcttgcccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtaagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctca

SEQ ID NO: 37339 - DNA, 417 bp, Homo sapiens
  misc_feature 7, 18, 35: n = A,T,C or G
caagccnccacgacaagnaaaccaggggaaagatntattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtac

SEQ ID NO: 37340 - DNA, 451 bp, Homo sapiens
  misc_feature 25, 177: n = A,T,C or G
tatgtctcgctccgtggccttagcngtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgactnactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatac

SEQ ID NO: 37341 - DNA, 299 bp, Homo sapiens
tgttcccaacacacctttgagacccaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtg

SEQ ID NO: 37342 - DNA, 181 bp, Homo sapiens
ctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttg

SEQ ID NO: 37343 - DNA, 222 bp, Homo sapiens
cagctttcgggggagagggtaggctggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctcccca

SEQ ID NO: 37344 - DNA, 123 bp, Homo sapiens
aagagatcctttcccatttattccgggaagatgtttttcaaactcagagacaaggactttggtttttgtaagacaaacgatgatatgaaggccttttgtaagaaaaaataaaagatgaagtgc

SEQ ID NO: 37345 - DNA, 370 bp, Homo sapiens
gaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 37346 - DNA, 496 bp, Homo sapiens
  misc_feature 479: n = A,T,C or G
ctacccaacttgccttcatgcgcctgctggccaactatgcctctcagaacatcacctaccactgcaagaacagcattgcatacatggatgaggagactggcaaccctgaagaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgngggcaaaagagaaaaag

SEQ ID NO: 37347 - DNA, 390 bp, Homo sapiens
  misc_feature 178: n = A,T,C or G
gtgaaattttaggagtttgggacccagtggccagactgaaattcagtgcatgtagggcagttgccaataaagtcacccttgggtacttgttcatagctttagatggaggaatgtttgttctctagctttaaggaattgagactggtatcatcggggcagtgtctgatggacctagttnagggaagttcatgggccagtgtctttgcaagtgaaactaggcatctttccccaatgagagagcatatggagacgttcactttaaggacgggttttgaaaggggaggtattggtggaacttaccaactttgttatgtagcctagttatcatttctgtaggtgtgtaacagtttatcaagtgcaaggagttacctctgaatcttctatatagga

SEQ ID NO: 37348 - DNA, 177 bp, Homo sapiens
  misc_feature 25, 176: n = A,T,C or G
caaatggcctttattaaaaactgantgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctnt

SEQ ID NO: 37349 - DNA, 119 bp, Homo sapiens
tgtccaaccttcaggccactcagcctacagttgggatgaatttcaaaacgcctcggggacctgtttgaattttttctgtagtgctgtattattttcaataaatctgggacaacagcctt

SEQ ID NO: 37350 - DNA, 451 bp, Homo sapiens
  misc_feature 4, 33, 60: n = A,T,C or G
tgancccctcaatatgcataggaaaagcatttnttaaaaatccaacatccttttatgatnaaaatcctcaaactaggactagaagagaacttctttaacctaataaaggacacatacaaaaaaccatctatgaaaaacatcatacttaatggtgaaatactgaatgttctccccataagatcaagaacaagacaaaggtgtctgctttcacttttcaatattgtactgggtgttctagccaggacagttggataagaaaaagaaataacagtcatccagattggaaaggaaaaagtaaatgctattcacagatgatataatcttctatatagaaaattacaaggaatccacaaaactattagagctaagaacaaattcagtaaagttgtgaggtacaagatcaatatacataggttaattgtatttctatacacgagcaataaacaatctg

SEQ ID NO: 37351 - DNA, 449 bp, Homo sapiens
  misc_feature 21, 22, 257: n = A,T,C or G
gtaaacagttttctttttctnngtaaatccttaataaaggtaacttcaatacatttggaaaccaggcaggcgtattagtcttctcaggctgctataacaatataccatagactgagtggcttaaaaaatagacataaatttttcacagttctggtagctaggaagtccaagatcagggtgctggccaattcacttcttggtgagggctctcttcctggcttacaggcagctgccttctcattgtgtcctcacgtggnggagactttctcttcctcgtcttataaagccactaattctttctctaaaggcttcactaacctttattagccatctcaccttgactacctctcaaaggtaccatctcctttcaacatatggatttcaacatacggattctggaagaacacaatgacgtctatagaagcaggatacaacatttaaatacaggg

SEQ ID NO: 37352 - DNA, 438 bp, Homo sapiens
  misc_feature 24, 25: n = A,T,C or G
ctgaagatcatggggaagatcttnnaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagaga

SEQ ID NO: 37353 - DNA, 137 bp, Homo sapiens
cacgtgagaccacagtgaaaagatggctgtctgcaagccagaaagaaagcccttaccagaaaccaaatcagctggcaccttgatcttggactttccaacctctagaactgtgagaaataaattcctgtggtttaaac

SEQ ID NO: 37354 - DNA, 267 bp, Homo sapiens
aaatcataaaaaacagtctctcagaccacagtgcaatcaaattagaactcaagattaagaaactcactcaaaaaatcacacaactacatagaaactgaacaacctgctcctgaatgactgctgtgtaaataacaaaattaaggcagaaataaataatttctttgaaaccaatgagaacaaacacacaatgtaccagaatctctgggacacagctaaagcagtgtttagagggaaattgatagcactaaatgcccactggagaaagca

SEQ ID NO: 37355 - DNA, 219 bp, Homo sapiens
atcttattccgagcattccagtaacttttttgtgtatgtacttagctgtactataagtagttggtttgtatgagatggttaaaaaggccaaagataaaaggtttctttttttttccttttttgtctatgaagttgctgtttatttttttggcctgtttgatgtatgtgtgaaacaatgttgtccaacaataaacaggaattttattttgctgagttgtt

SEQ ID NO: 37356 - DNA, 284 bp, Homo sapiens
  misc_feature 25: n = A,T,C or G
tatataaatgagtatagttagtgcncgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtgcagaggg

SEQ ID NO: 37357 - DNA, 277 bp, Homo sapiens
tcctcttgatcgggaactcctgcttctccttgcctcgaaatggaccccaactgctcctgctcgcctgttggctcctgtgcctgtgccggctcctgcaaatgcaaagagtgcaaacgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctg

SEQ ID NO: 37358 - DNA, 144 bp, Homo sapiens
  misc_feature 24, 108, 133, 138: n = A,T,C or G
tacatatctagtaggagtcccagngagagattataaaagagagagtatatgcaaaagtaaataactagaaattttttagaatttaataaaaacatgagatttcagatngaaggaatgcattgagaccactgcnggggntacaca

SEQ ID NO: 37359 - DNA, 133 bp, Homo sapiens
  misc_feature 21: n = A,T,C or G
ctttgaagaacttctgaaggngtctcggaacccttcagggtctacagactacacttgcaaaattgctagattatgcttcatgctggttcgaacaagagtaactaagattaatatagaaaatagtttctatgag

SEQ ID NO: 37360 - DNA, 172 bp, Homo sapiens
  misc_feature 4, 16: n = A,T,C or G
cagntaccttatttcnaaatgtttggaaacagtataatttgacaaagaaaaatgatacttctctttttttgctgttccaccaaatacaattcaaatgcttttgttctatttttttaccaattccaatttcaaaatgtctcaatggtgctataataaataaacttcaacactc

SEQ ID NO: 37361 - DNA, 110 bp, Homo sapiens
  misc_feature 2, 7: n = A,T,C or G
gngtccnaaaagtatcacttatatgcagtgcttatacatgtaagtgcattactttgctcaaatatcttctgacctattacagtcaactcatgcgtgagtgtgaacagtgt

SEQ ID NO: 37362 - DNA, 339 bp, Homo sapiens
  misc_feature 24: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagatt

SEQ ID NO: 37363 - DNA, 388 bp, Homo sapiens
  misc_feature 44: n = A,T,C or G
tatggccggggcaccactccgctgaagagctcaggaattgaatntggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttg

SEQ ID NO: 37364 - DNA, 398 bp, Homo sapiens
cttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattctta

SEQ ID NO: 37365 - DNA, 361 bp, Homo sapiens
  misc_feature 21, 125, 261: n = A,T,C or G
tgtcgtgaaaactacccctancagccaaaatgggaaaggaaaagactcatatcaacattgtcgtcattggacacgtagattcgggcaagtccaccactactggccatctgatctataaatgcggnggcatcgacaaaagaaccattgaaaaatttgagaaggaggctgctgagatgggaaagggctccttcaagtatgcctgggtcttggataaactgaaagctgagcgtgaacgtggtatcaccattgatatctccttgnggaaatttgagaccagcaagtactatgtgactatcattgatgccccaggacacagagactttatcaaaaacatgattacagggacatctcaggctgactg

SEQ ID NO: 37366 - DNA, 284 bp, Homo sapiens
tcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacg

SEQ ID NO: 37367 - DNA, 392 bp, Homo sapiens
  misc_feature 32, 383: n = A,T,C or G
gaaggccctgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaac

SEQ ID NO: 37368 - DNA, 213 bp, Homo sapiens
  misc_feature 17, 24, 35, 48, 49, 57, 58, 86, 103, 105, 128, 174, 199, 201: n = A,T,C or G
tctgaggaaccaaaaanaagccgntaccacgattnctgaagagctggnntaggaagnncatttcttccttttgagggacatgtgcntaaaacaagaacaagcngngtgaaatcacatgattgtactgngggctcaagaaaccgggagagaacccccaccgtggacacccgcctntagggccacagggaaaagggaacgntnccagggcatttt

SEQ ID NO: 37369 - DNA, 459 bp, Homo sapiens
  misc_feature 3, 6, 25, 35: n = A,T,C or G
agnccngccacttgctagcccaaanaaggaggttntggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccag

SEQ ID NO: 37370 - DNA, 193 bp, Homo sapiens
  misc_feature 21, 22, 161: n = A,T,C or G
gacatttggagaagaaagttnncacactaacccagataatagtttttatgcctggaattttttgcagtttgatttgtatacgtatgacctcttgaaatgttaatttttaataaaatttgtaacacttaaaaatttctcagtttgggtttttttttttaagnggaagtttaattaaatgtttagttttatttta

SEQ ID NO: 37371 - DNA, 121 bp, Homo sapiens
  misc_feature 66, 81: n = A,T,C or G
aaacatggtctcattgctctgacaattattttcccctatcaactgctagtttatattatatagggnggaatttaatggtangtgattcccatatgtctttaagtcataaatccctttggcc

SEQ ID NO: 37372 - DNA, 371 bp, Homo sapiens
  misc_feature 25, 181: n = A,T,C or G
cagaaggggataaagctaatacacnagtaaagaaaggtaactaagtagagaaaggtaaattcttcccttttaaaagcatgtaaatgttcacttttcagttcaaaacaagagaaaaatggcatgttttccatagttgttaatatttagtaccgaaataacagaacacttatgatattatggncattgtaattcatgaaattaaatagatattattgcctttgggaaacatgtttttattgtcatttaaatcacatattaagaaaataatattgctataatttttagtccctcctttgagttctttctagctaagcactttcaatgtgtaaaatatctatccttcttacagagagacaagtatacaaatagtt

SEQ ID NO: 37373 - DNA, 100 bp, Homo sapiens
tgaggcaggagaatcacttgaaccagggtggcagaggttgcagtgagccgagattgagccactgcactccagcctgggtgacagagtgagactccgtccc

SEQ ID NO: 37374 - DNA, 345 bp, Homo sapiens
  misc_feature 34: n = A,T,C or G
aacggacccctgatgcttaagatactacattatntatttattttgcaaactgtaatctccgccaaaagttgtaatattgctgtgcatcacaataaagctcctactttttcgaaaggggtttctactgctattgggcgcgcagaagatacttaatgttgtgtggccagtcgttgcttcgctttaaactcctaattcttaaattagctgggcacagtggtgcacacttgtagtcccagctactcgggaagctgaggcaggagaatggtgtgaacccaggaggcggagcttgcagtgagccaagatagcgccactgcactccagcctgggcaacagagcaagactccg

SEQ ID NO: 37375 - DNA, 470 bp, Homo sapiens
  misc_feature 3, 4, 8, 34: n = A,T,C or G
aannggcncttgtgacgatcctcatgaatgactntttctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgca

SEQ ID NO: 37376 - DNA, 398 bp, Homo sapiens
  misc_feature 23: n = A,T,C or G
caaagttcacaatgtggccgagnactttgattgcacattgttgtttttttaatagtcattccaaatatgagacgcattgttacaggaagtcccttgccatcctaaaagccaccccacttctctctaaggagaatggcccagtcctctcccaaatccacacaggggaggtgacagcattgcttccgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacac

SEQ ID NO: 37377 - DNA, 121 bp, Homo sapiens
gcacataaggggaacttcgtgatgcaagcacaagtatcaacagctgaattgatcaagcagaaaaaagaatatcagagcttgaagactatcttgccaaaataaggcaggcagacaagattag

SEQ ID NO: 37378 - DNA, 495 bp, Homo sapiens
tcaaatgttttctcagttcatagtttttaaaaaattatttttaaatgcccttttccattcctattaagcatagtattgaaagttctagccaaggcaatcaggcaagagaaagcaataaagcgtattcaaacaggaagagaggaagtcaaattgtctctgtttgcagatgacaagattgtatatttagaaaaccccatcgtctcagcttatctccttaagctgataagcaacttcagcaaaatctcaggattcaaaatcaatgtgcaaaaataacaagcattcctatacaacaacaacagacaaacagagagccaaatcatgagtgaactcccattcacaattgctacaaagagaataaaatacctaggaaaacaacttacaagggatgtgaaggatctcctcaaggagaactacaaaccactgttcaaggaaataggagaggacacaaacaaatggcaaactattccatgctcatggataggaagaatcaatatg

SEQ ID NO: 37379 - DNA, 369 bp, Homo sapiens
  misc_feature 3, 6, 7, 33: n = A,T,C or G
gtnctnncctgggctcggaacctaggtcgcggntttatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttat

SEQ ID NO: 37380 - DNA, 492 bp, Homo sapiens
  misc_feature 8, 33, 34, 35, 36, 61: n = A,T,C or G
ctacatcnctcagcccacatatttacattttannnncatttgtattttaccaattattttnaaaacagcctttatttcttaaagattatagtcatgtgaactgaaaaggtattacagcttttattttttttcaaaaaatatttgatctaagtgcttattttcctagagcttttttatataaacatcacgcccataagaaatataaaattacacagatgaacaaaagcaaattcagtacttgtaagaattttcatttgccaatcttctgaatagattattggcctctgggtgaagcccttcaagagcagggtctaggacagcatacagtttctagggcctaataaacaggcatagctggaagacagagacagattttgagaaggatctatccacttttaattcctggagtttcgtgaggaaaacagagggtgttttttccccaaaatggggtctgtggcaccttctttgttttttcccaggagccccgggcta

SEQ ID NO: 37381 - DNA, 396 bp, Homo sapiens
  misc_feature 61: n = A,T,C or G
agcaaaccccaaatgaacaaccccttcagaatgtttttgaagagctgatccagtggacaanagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataatttta

SEQ ID NO: 37382 - DNA, 498 bp, Homo sapiens
  misc_feature 10, 26, 28, 32, 47, 98: n = A,T,C or G
cttacctggnccagaaaacccccggncncttnggccgggaagaatcnctgcagctagcctgaaagactgatttttttggctaagttgggattgagttncaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatact

SEQ ID NO: 37383 - DNA, 125 bp, Homo sapiens
  misc_feature 1, 19, 26, 29, 41, 50, 93, 100, 119, 124: n = A,T,C or G
naagggatcaaacctgagnccagtcnagnttctggtactangccaccaangtgcaggtgatacacatggacacagcacttgttgaactgcacnatgagtntacagtcagcaaaatccanactgng

SEQ ID NO: 37384 - DNA, 149 bp, Homo sapiens
agcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtg

SEQ ID NO: 37385 - DNA, 500 bp, Homo sapiens
  misc_feature 24, 25, 27, 28: n = A,T,C or G
ctaaaggaatcccctcaattcaanntnntagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacgga

SEQ ID NO: 37386 - DNA, 149 bp, Homo sapiens
  misc_feature 148: n = A,T,C or G
cagcaacccggtccagtactgggagatacagccatccaccttcagatgtgtctacgtgcgctctgccattcaactcggaaactataagtaattctcaagaaagccctcatttttataacctggcaaaatcttgttaatgtcattgcgna

SEQ ID NO: 37387 - DNA, 476 bp, Homo sapiens
  misc_feature 2, 7, 31, 61, 294, 441, 474: n = A,T,C or G
anaaccncgtggaatatctctaaaatgcttnttttaaaaaaagtcaactcagaaattgccnttctagtgaaagtattcttccagaatgaagatgaaataaagctattttcagataaaagaaaacagagattcttgtcggcagcagacctccactatgagaagcgctaaagaaagttctttaggacgggcacgatagctcacgcctataatcccagcattttgggaggccaaggtgggaggattgcttgagctcggaagatggaggctgcagtgagccatgacggtgccactgcnctccagcttgggtgacagagtgagacgctgtctcaaattggaagagcagagctgcagacaggaataagaagaacggtaaatttgaagatgggaccgtctagttgcaagaaaacaagctcagggctcccactgattctacattacggngagttgtataattattaatattttcattatatntt

SEQ ID NO: 37388 - DNA, 126 bp, Homo sapiens
  misc_feature 24, 125: n = A,T,C or G
gtcgatgaagaacgcagctagctncgagaattaatgtgaattgcaggacacattgatcatcgacacttcgaacgcacttgcggccccgggttcctcccggggctacgcctgtctgagcgtcgctng

SEQ ID NO: 37389 - DNA, 436 bp, Homo sapiens
  misc_feature 36: n = A,T,C or G
catggccccaaacatataaaaagggaaattattttntattatgaatgaaataaaaatgactgtaaaacgtatcagaatttgcagcatatcactaaagaagtagttgggggaaatttacagcactgaatgcctatgtttgaaaataagaaattagcatctaaagaagctagaaaaagaacaagaaattaaatctaaaatgagtagaggaatagaaataattaagattaaagtagaaatcaatgaaatagaaaccaatagagaaaagcaatgaaataaaaaagaaacttgttctttgagaagtccaataaaaactttcagctaagtaggaataaaatagaacttcctcaagttgataaaggacatctacaaaaaaccctataactgacatcatactcagtggtgaaaaacggaatgcccttccgccatcagtatttca

SEQ ID NO: 37390 - DNA, 427 bp, Homo sapiens
  misc_feature 14, 23, 28, 175, 176, 342, 364: n = A,T,C or G
gcatttctctgatnaggggcccngagcnttttttcatatatctgttggccatttgcatattgtcttttgagaaacgtctgttcagattttttttgtccattttaaaataaaaactccaaatgtttgacctacctaagaggtgatttaaaatgcccaagtgatcagggaagaaatnntcagcgtcttgctggtgtaaaaagcaccacagacttctggtcaatatggtagactaagtcaatacaggaagacatttgccccttcccccacacagagattctggaagaagtataacttccaaatgcataatgttatgtaagagcaagaaagaaaaattcccaaggngtaacctggggcaaattttggnccgctaggatatttgaacctaaaatagcactagggttcagttcccctgctgagaacaggaatc

SEQ ID NO: 37391 - DNA, 302 bp, Homo sapiens
  misc_feature 46: n = A,T,C or G
catctgtcccgctgcgtgtttttcctcttgatcgggaactcctgcntctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggat

SEQ ID NO: 37392 - DNA, 498 bp, Homo sapiens
  misc_feature 24: n = A,T,C or G
atcctttgggtaggcagtaagtcntcgtcacaaaactgctccacctcagtgtaatgcagcagaaaagtacttattgatagcatttcttgtagcatttatgacttccctaacatttgtcctggcaggataaaacctaggattgagcctgtgctttgagacatgagtcagcctttcctcccacattccctgctttgttcctgagcatctctgctttttctgtcttttgtcaatttctccttggcccctccagttgttcgtggggatcgtgcagttctttccactcaaacattcttccactcactctaaaatgtgactctgagctgggtgcggtggctcatgcctctaatcccagcactttgggaggccaaggtgggcagatcactttgaggtcaggagatcgagaccagcctggccagcatgacgaaaccccgtctctactaacaatacaaaaaattagccaggtgtggtggcaggcaccttgtagtaccagctactcag

SEQ ID NO: 37393 - DNA, 387 bp, Homo sapiens
  misc_feature 24, 25, 385: n = A,T,C or G
tcaacagtgtttggacggaacagnnccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccactttcttccgcgaattggccgaggagaagcgcgagggctacgagcgtctcctgaagatgcaaaaccagcgngg

SEQ ID NO: 37394 - DNA, 465 bp, Homo sapiens
  misc_feature 23, 176, 177, 390, 402, 446: n = A,T,C or G
tgcatcttattttgtggatttcncctaggctgttttttgtgctttcttttaaaaatatataggttttaataatcttaattttcttttagtttgaaatgtatatactcattttattcattagtctaagataagaattgtaacacttctctaacctattatagaattgttaatacctnnacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaagganaacttttagggntaccttttctactaaatttcccaatttttgaccagatataatcntatattgggccctccctga

SEQ ID NO: 37395 - DNA, 267 bp, Homo sapiens
agaccactgacttgagaacggtgcagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgagg

SEQ ID NO: 37396 - DNA, 485 bp, Homo sapiens
  misc_feature 12, 69, 70, 115: n = A,T,C or G
tatggccggganctaccctaaaggtaacctgttatttggattttcagcatttctcttggttaaaatganngtccggttattttagaactagagttgagatgaatatgacacttcntaattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctccagaatgctgttctatgaaattggcaaataaatgaaggtattcaatttttgag

SEQ ID NO: 37397 - DNA, 122 bp, Homo sapiens
gtagctaggtgtggtggctcatgcctgtaatcccagcagtttgggaggctgaggcagaaggattgctcgaggtcatgagtttgagcccggcctgggcaacacggcgagactccgtctttaca

SEQ ID NO: 37398 - DNA, 493 bp, Homo sapiens
  misc_feature 1, 7, 34, 36, 37, 62, 63: n = A,T,C or G
naaaganccctctcacataagcccagttcatcantnntttcctcctttacctttcagtgcanncttcttttcacattaggctgttggttcaaacttttgggagcacggactgtcagttctctgggaagtggtcagcgcatcccgcagggcttctcctcctctgtcttttggagaaccagggctcttctcaggggctctagggaccgccaggctgtttcagccaggaaggccaaaatcaagagtgagatgtagagagttgtaaaatagaaaaagtggagttggtgaatcgggttgttctttcctcacatttggatgattgtcataaggtttttagcatgttcctccttttcttcaccctccccttttttcttctattaatcaagagaaacttcaaagttaatgggatggccggatctcacaggctgagaactcgttcacctccaagcatttcatgaaaaagctgcttcttattaatcatacaaactctcaccat

SEQ ID NO: 37399 - DNA, 362 bp, Homo sapiens
  misc_feature 81, 84, 92, 109, 176, 194, 262, 291, 294, 312: n = A,T,C or G
gtagagttgactgtatgtatccccaaaatgaatatgcagcagtgattttttttttctcctccctgatctctttcctgcttnggnaattctgngagggggtaatcatatnggggctgtccttggcaggttaggtgacatacaagaacatgtggttccacagcagtcctgtcattctngggtaagaacatcaaagngagttgcagcacttctgcattcatacacgtaaatcttaatctggaaggaagatagaatctaccatagngaatttctccagaagttttacacctgagngcncccagatctgtaggcgtngacccaatccagttgccctagggaaattctagacccaggagatcctaacc

SEQ ID NO: 37400 - DNA, 126 bp, Homo sapiens
  misc_feature 23, 24: n = A,T,C or G
gatgaagaacgcagctagctgcnngaattaatgtgaattgcaggacacattgatcatcgacacttcgaacgcacttgcggccccgggttcctcccggggctacgcctgtctgagcgtcgcttgcgc

SEQ ID NO: 37401 - DNA, 205 bp, Homo sapiens
  misc_feature 177, 178, 183: n = A,T,C or G
taacagcagactcagctctgacatcctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgnncaggntatctaagttaatttaaaggtg

SEQ ID NO: 37402 - DNA, 393 bp, Homo sapiens
  misc_feature 25, 26, 385, 393: n = A,T,C or G
aagattaggtcaaaatggaacagcnnttactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttattgtatatagtcagcaaaaaattatggtttgcataaatggaaatgtacatgaattttaaaaattttaagatatttttaatttaataaaatttatataactatattgnatttattn

SEQ ID NO: 37403 - DNA, 473 bp, Homo sapiens
  misc_feature 22, 23, 375: n = A,T,C or G
ctgcagggtttattatataatnnttttggatttgtcaccagagtgaacaaacattgaagaacatgttatgagtctataaggaagttagcttagatggatcacagagtagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggngtctgaaaatgataagcatttggattagctattattattaactccaactgggcttaatttgaggtcaggcattattttgttgaaattttaaaaagact

SEQ ID NO: 37404 - DNA, 411 bp, Homo sapiens
  misc_feature 24, 240: n = A,T,C or G
gataatgatgaaaatgagcaccanctatctttaagaacggtcagtttaggggctggtgcaaaggatgagttgcacattgttgaagcagaggcaatgaattacgaaggcagtccaattaaagtaacactggcaacttttgaaaatgtctgtacagccaacggtttcccttgggggctttgaaataacaccaccagtggtcttaaggttgaagtgtggttcagggccagtgcatattagtgngcagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaaga

SEQ ID NO: 37405 - DNA, 197 bp, Homo sapiens
  misc_feature 174, 196: n = A,T,C or G
tgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggngaataaactgacatgcatgctnc

SEQ ID NO: 37406 - DNA, 301 bp, Homo sapiens
  misc_feature 182: n = A,T,C or G
acaaaagaaacttctggacattgacggattatattcaaaagttcgatctcgatatagtttcatacaggctcttgtcaagacgtatccgtggcctcttgaggatatcaaggaactgagagcccgtgcttatgctcttctatgagagagatgaattggggagaattgtctccattttatagatnagtttctttctaaattatgaccaaaaatattttgctatttctttctttgtatatggacatcttttctgtaaacttcttcccctagttccatcctcactagtaaaaaataaatacttttt

SEQ ID NO: 37407 - DNA, 252 bp, Homo sapiens
  misc_feature 21: n = A,T,C or G
gtattatcttagtgtctttgncttcctagtctcttggacctcgcaatacccaaatatcccagtgatttaataatcatgttgatggtgttgggtatttttttccaactgggaaagtaaagggaaacagcaaagattacttatcagatgagtgcaggaggcagccatgccattcagaccaccccagttccaacaccacctctagaagatcagaacatgctgtcttgccctcagaatagtgaatgataaatggca

SEQ ID NO: 37408 - DNA, 466 bp, Homo sapiens
  misc_feature 23: n = A,T,C or G
aggccgcaccttggacgccatgncggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgc

SEQ ID NO: 37409 - DNA, 275 bp, Homo sapiens
taatttttttatctaatgatcatcctgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttc

SEQ ID NO: 37410 - DNA, 500 bp, Homo sapiens
  misc_feature 25, 453: n = A,T,C or G
atgtcacagagcagcaacactcacnagaaaggatcccaagcatggtgatatgctaaacctaggtttctatgtctgtaaatctgctgtactgaaggtaacgttgtatggactgaatgtaaaacaaagagactggttatggcggtgggagagagacttcactctaatgtattccactctcaaactgaagacttagggcctgtagctctttggtgtcttcaaatgagttatgagatagatattagaatgcaaagtgattctttgtggatagtgtcagggtgaggattgctatatccctgagggtgggacatgtcaggggattagtgtgtcctgaggtgaaatgtttcagaagcgtttctgagtagggttatgaccccatagcaataggttccacagacaagaaacattccctgcaaatagaccaacctgcatttgtatagatttaattctgcaggngattaagttaagccaaagaagcactctgagaatcaggggcagagtct

SEQ ID NO: 37411 - DNA, 309 bp, Homo sapiens
  misc_feature 179, 308: n = A,T,C or G
atttgaaacctggaaatacagtaacatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagngtcagaaaatcctatttatgaatcctgtcggtattccttggtatctgaaaaaaataccaaatagtaccatacatgagttatttctaagtttgaaaaataaaaagaaattgcatcacactaattacaaant

SEQ ID NO: 37412 - DNA, 349 bp, Homo sapiens
  misc_feature 16, 22, 177, 313: n = A,T,C or G
agaagtggtggtgacngaaacnctttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcancaggttcggatgagtctcatgtggctgctgacctccagatatatgctctcgaacagtgtggcctgatgaaactatgggaccctttggacctcaagatcagaggttccagcttcctgggaacataggttttgattgncacctcaatgggactgcttcacagaagaaaagcctg

SEQ ID NO: 37413 - DNA, 470 bp, Homo sapiens
  misc_feature 18, 24, 175, 177, 179, 458: n = A,T,C or G
gtaccagtgcattaattngggccnggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagngngnggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattggttattttaaacttatctgtttgtaaattgnaactgattaaga

SEQ ID NO: 37414 - DNA, 147 bp, Homo sapiens
  misc_feature 19, 24, 27, 114: n = A,T,C or G
tccacatacgattctactngtcanccntgcccaagaaattgctgagaaaattcaacaacgaaatcaatatgaaagaaaaggtgaaaaggcaccaaagcttaccgtgacaatcangagctttgttgcagaacctgaaggaaaagatcg

SEQ ID NO: 37415 - DNA, 156 bp, Homo sapiens
  misc_feature 4, 86, 141, 154: n = A,T,C or G
tgcngtgcagtggcgcgatcttggctgactgcaacttctgccttgagggttcaagtgattctcctgtctcagcctctcgcgtaggngggattacatgccaccacggccagctgatttttgtatttttagtaggccaggagntcaagaccagccngg

SEQ ID NO: 37416 - DNA, 102 bp, Homo sapiens
tcaatagggaagcctgtgatgactacagactttgcgaacgctacgccatggtttatggatacaatgctgcctataatcgctacttcaggaagcgccgaggga

SEQ ID NO: 37417 - DNA, 390 bp, Homo sapiens
  misc_feature 285: n = A,T,C or G
tgtttatgtaacatacccatttgcttgggtatcatttcataccagcaaactaataggaataattttgtgaatgatcttctattttgctaaatttgctaattttgctaaattttgctaaatttgcgagtgatcttctattaagtggagtccatagagcagtagagaataaaattagaaaaaatggccagccatggtggctcacacctgtaatcccagcactttaggaggctgaggcaggcagatcacttgaggttaggggttcaagaccagcctggccaacatggngaaaccttgtctctactaaaaatatgaaaattagctgggcatggtggcgcatgcctgtaatcccaactactcgggaggctgaggtgagagaagtgcttgagtctg

SEQ ID NO: 37418 - DNA, 377 bp, Homo sapiens
  misc_feature 21, 23, 176: n = A,T,C or G
atgctaacctgatgcactgcncnaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccnaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttg

SEQ ID NO: 37419 - DNA, 268 bp, Homo sapiens
  misc_feature 1, 2, 24, 25, 200, 201, 210, 267: n = A,T,C or G
nnacgagcacgtgctaaagttttnncacaagtacagtgagcgaatccccctgtatgagaagaaggggctccacgagaaagctctgcaggtgctcgtggaccagtccaagaaagccaactcccctctgaaaggccacgagaggacagtgcagtatctgcagcatctgggcacagaaaacctgcatttgattttctcctacnnagggggggngctgagagacttcccagaagatggcctgaagatatttactgaagatctcccggaagng

SEQ ID NO: 37420 - DNA, 479 bp, Homo sapiens
  misc_feature 15, 21, 175, 176, 462, 465, 478: n = A,T,C or G
agcttagtcataatnaagaancagtgaaagaaagtgcctgagattatgataatatgtgaaaagagccagtggtagctaggaaggtatatagttagtggagttttaatgaagtatgcttcattttcctcctcagttatctaatcatgcacatacgaaccatagtattgctgatgcnntcatacaatgatatttaaaaatcaatggggtaatggaaatagacaattgatctggcttcaagtgaggtggcatatggtggcatcgtgtatcttaggctacagtgctctggttaaaagatgaagggctacatagaatgactttaacctataaccaattgtccattatttggaaagcagaggatacataaaagtaaaataaggagcctgtcattcttccctttgaattcacatcaattagaaatattgtccttatcaagggggccatctaggaccataacaaaaaagnctngtattatctgttng

SEQ ID NO: 37421 - DNA, 120 bp, Homo sapiens
aggatccccaaggcctgttccctgatctccatcatttcttacaggttttcctccctcaagcaattcgacatctcaagtgaagacatggcccctgaagggcaataaagctgctagtttatt

SEQ ID NO: 37422 - DNA, 490 bp, Homo sapiens
gggaaagagcaagttcctggtgcaagggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagc

SEQ ID NO: 37423 - DNA, 482 bp, Homo sapiens
  misc_feature 2: n = A,T,C or G
anagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagtt

SEQ ID NO: 37424 - DNA, 432 bp, Homo sapiens
cttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattt

SEQ ID NO: 37425 - DNA, 472 bp, Homo sapiens
gaactaataatacatatacatttactctgggttatatatcatgacagaatacacttgacagtcatttattcttgattttatattttggaatatgaaaattcaaacatcagctaacttatgtttgctcacttatcttcatattctcatcaccaaattgtaaaacacgggtgcttcagagatttccgttttgattttcaagcttaaaccactgaaaggttgtgttatggtgtgttcttctctgaagccttcactgccagtcggtctgcaatttctcttttaaatctctggttgtttagtttctaattgaatgacagttaaacattttgaatccaactgaaatttacattttaggggattactttgcatgatcatctgaatattcaatatccttatattaataataaatgaaaaaaatgacaggtggattttacttttccctacaaaaaattctttatagctcttgtttgatcac

SEQ ID NO: 37426 - DNA, 466 bp, Homo sapiens
  misc_feature 14: n = A,T,C or G
agagatggaaaatnaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattat

SEQ ID NO: 37427 - DNA, 159 bp, Homo sapiens
gggcggcggcggcggtggaggagccggagcataatgctaaagaagtaaacaggtcatggcacgtttaacaaaaagacgacaggcggatacaaaagctatcctgcatctttgggcagccattgagattatacggaaccagaagcagattgccaacattga

SEQ ID NO: 37428 - DNA, 111 bp, Homo sapiens
  misc_feature 4, 14, 29, 35, 111: n = A,T,C or G
gaanccttgaaganattttgctaagtganataacnagacacaaaaggacaaatactgtttgattccacttactatgaggtacctagaacaggcaaatttacagagacagan

SEQ ID NO: 37429 - DNA, 487 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttggtttaaaagttgtaggtgattaaaataatttgaaggcgatcttttaaaaagagattaaaccgaaggtgattaaaagaccttga

SEQ ID NO: 37430 - DNA, 305 bp, Homo sapiens
catggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgag

SEQ ID NO: 37431 - DNA, 475 bp, Homo sapiens
  misc_feature 13: n = A,T,C or G
aggtcccatgccnaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcggat

SEQ ID NO: 37432 - DNA, 116 bp, Homo sapiens
  misc_feature 14, 22, 27, 33, 79, 106: n = A,T,C or G
gtaaagttgagggnactggtgngttgnatgttnaattcagcaccagcattgcatgacagttgtttgaataacaagtggnttatttttaaaaccataccttttaaantttaggttca

SEQ ID NO: 37433 - DNA, 117 bp, Homo sapiens
  misc_feature 8, 10, 19: n = A,T,C or G
gggaaatnanggttcgatntcccggaaaaggagccctgagaaacggctacccacattccaaggaaggcagcaggcgcgcaaaattaccccactcccgaccccggggaggtagtgacg

SEQ ID NO: 37434 - DNA, 462 bp, Homo sapiens
gggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtaagttttgtaaacactatagcatctgttaagatccagtgtccatggaaacattcccacatgccgtgactctggactatatcaagtttttggaaagcag

SEQ ID NO: 37435 - DNA, 483 bp, Homo sapiens
atggccgggatatctaggcactaaaaacaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagtatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactatttatttttctcttagtcttcttatttaattaac

SEQ ID NO: 37436 - DNA, 489 bp, Homo sapiens
tatggccgggggcagtcattcctgcggcttgcgcgccccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccaagtttgctgatggtcgccaaagttggagttagtatgttcaacagaccccattagcagaagtcatgttccagcttagactgatgaagaatt

SEQ ID NO: 37437 - DNA, 222 bp, Homo sapiens
  misc_feature 141: n = A,T,C or G
gaggcattgaggcagcccagcgcaggggcttctgctgagggggcaggcggagcttgaggaaaccgcagataagtttttttctctttgaaagatagagattaatacaactacttaaaaaatatagtcaataggttactaagnatattgcttagcgttaagtttttaacgtaattttaatagcttaagattttaagagaaaatatgaagacttagaagagtagc

SEQ ID NO: 37438 - DNA, 309 bp, Homo sapiens
  misc_feature 269, 300: n = A,T,C or G
gggttttaagcaggagtttgaggctagtctggccagcgtgatgaagccctggctctgctaaaagtgcaaaaattatctgggcatggtggcaggcgcctgtgattccagctactctggagtctgaggcaggatagtcgttttgggcccgggaggcggaggttgcagcgagccgagatcgcgccattgcactccagcctgggcgacagagtgagactgtgtctcaaaaacaacaaacagcacaccaaaaccaaaaaccaaaaaactttggnagagcaattatgacttctggtttttggctangcaggttat

SEQ ID NO: 37439 - DNA, 500 bp, Homo sapiens
  misc_feature 2, 7: n = A,T,C or G
gnaaaanggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggt

SEQ ID NO: 37440 - DNA, 313 bp, Homo sapiens
  misc_feature 181, 187, 208, 232, 244, 256, 267: n = A,T,C or G
gagcagcaggaggaggcagagcacagcatcgtcgggaccagactcgtctcaggccagttgcagccttctcagccaaacgccgaccaaggaaaactcactaccatgagaattgcagtgatttgcttttgcctcctaaaggcatcacctgtgccataccagttaacaggctgattctggaagntctganggaaagcagctttcaacaaanaccagatgctggggccaatgggtnaaccctgacccnttttaaaaacanaattttcttancccccaaaaaatgggtgggccctttggaaaaaaccatttttttttt

SEQ ID NO: 37441 - DNA, 471 bp, Homo sapiens
  misc_feature 3: n = A,T,C or G
gancccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttgctgctcgtaaattcatttggacgaaccataaattcaacgtgactggcaccccagaacaatatgtaccttattctaccactagaaagaagattcagggagtggatcccaccttcaacaccttacaagtaaag

SEQ ID NO: 37442 - DNA, 156 bp, Homo sapiens
  misc_feature 5, 15, 31, 49: n = A,T,C or G
tctanggcccggganagtaaacgttctgaanaacttaccctgcccaganctagttgttttgggagtggggacattaaagggttcaaagggattttactccttagtcacagaattcttttaaacaaggaatacatactattatttgtacagttattc

SEQ ID NO: 37443 - DNA, 315 bp, Homo sapiens
gacactgaaagcattaacaagtgtacagagagtgaatttttcctggatgattctggaggttcttcaaaatcctagggtctttgcacatcattgtgagtatcaattctcggtcccagagttttgcttatctctaaaatgagaggatacattcattcatgcattcattcattcactcatttaagacgcatgttagacacccactgtgttctagacactgaggcaggacatacataaggtaatccctaagattcctgccagctctgacaactttttttattctgtaataagtgaccaataaagtgagatttttgttac

SEQ ID NO: 37444 - DNA, 460 bp, Homo sapiens
ggatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaata

SEQ ID NO: 37445 - DNA, 491 bp, Homo sapiens
  misc_feature 25, 29: n = A,T,C or G
tatggccggggaccaaccttagccnaacntttacccaaataaagtataggcgatagaaattgaaacctggcgcaatagatatagtaccgcaagggaaagatgaaaaattattaaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagcttggttgtccaagatagaatcttagttcaactttaaatttgcccacagaaccctctaaatccccttgtaaatttaacctgttagtccaaagaggaacagctctttggacactaggaaaaaaccttgtagagagagtaaaaaatttaacacccatagtaggcctaaaagcag

SEQ ID NO: 37446 - DNA, 481 bp, Homo sapiens
  misc_feature 471: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaaga

SEQ ID NO: 37447 - DNA, 314 bp, Homo sapiens
  misc_feature 1, 10, 39, 40, 61, 194: n = A,T,C or G
ncggcccctntggcccgggagtgtttttcaagataaganncgtctcttttttcaaaattcntgattgcagtttaaatcctcatatgacgtgtgggtgggagcaaccaaagttatttttacagggactttattttttgatctttatttgagattgttttcatatctatctaaattattaggagtgtgtgtatcangaagtaattttttaatgtcttctaaggatggtcttccaggcttttaaactgaaaagcttaattcagatagtagcttttggctgagaaaaggaatccaaaatattaataaatttagatcac

SEQ ID NO: 37448 - DNA, 360 bp, Homo sapiens
  misc_feature 21: n = A,T,C or G
tatggccgggatcttaagaanatctgtaattttttcttcttgctttgtttctgtgtcgtttttttaaatgatggaaattttcccggaagttcttctccccacagagagagaacagtacacaaaaaggctttttccattttctctcccttaatttagagaaattcacagttgtgcaagagtgaaagtttttcaggttggtcagaaagtgtctaagcaggaatacgctctcctccctgatagctgagaacattttaatgacagattttgcttaaataaaaaatcagaaaggtctcaagtctttcaaaatagaatgggggggaaaacgagtgaatccaatgaatcgactctaaacttatcctg

SEQ ID NO: 37449 - DNA, 160 bp, Homo sapiens
  misc_feature 160: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttacn

SEQ ID NO: 37450 - DNA, 460 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagatagaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatt

SEQ ID NO: 37451 - DNA, 224 bp, Homo sapiens
  misc_feature 224: n = A,T,C or G
gaaggaaacagatggaataaatgctacccaacaataacctggaagcacattcctggaatgagatttaggatttctgcctggaagtacattctggaatgaggtttaggaaggggttcccaagcaaggcaggttggtcttaactgagttgaggagacagatatcagaattcaaggaggctacattagttggctgttgcaaagcagagttctgaacagaagagagcn

SEQ ID NO: 37452 - DNA, 462 bp, Homo sapiens
  misc_feature 17: n = A,T,C or G
ggttctccaattaaagnctgttaacgtgtactacgctgtttccttgttggattttcttgttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaac

SEQ ID NO: 37453 - DNA, 201 bp, Homo sapiens
caataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctcctcactctctcaatcttatccatcatagcaggcagttgaggtggac

SEQ ID NO: 37454 - DNA, 482 bp, Homo sapiens
  misc_feature 48: n = A,T,C or G
gttatagctacatggaagaaagctctgtggattcatcactgtggtgtnctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagcctttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaaca

SEQ ID NO: 37455 - DNA, 466 bp, Homo sapiens
aggaatggcagggctgggattacaggcgtgagccaccgtgcctggcattaatgttgaaatagaatagaggtttaaccttggaataaaagaaagaatcagcaaatacattatctgagcctacatacactttgtaaaaagtatacttccactgttcagaattagatgatggcacaaaacctgttgaggtcttcattcatccttacaaatgtttattatgctgagtgtcccaggtgactggatacagtggagtgaattagaaatttgaaattattgccctgaggggacctacattcttcttgttggagtgcgtctgtgtgggataaggtagacaaataatataggaaattcaaaaaattgtttcagaccatagtaagttctatgccagaaatgaatagtccatatgataagaggaacagacattgtgagatgttggatctataggaaaagaggaacagacgccatgttc

SEQ ID NO: 37456 - DNA, 316 bp, Homo sapiens
gtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgct

SEQ ID NO: 37457 - DNA, 420 bp, Homo sapiens
ggaacctacaagtatgccatgttacctggcaaaaagcacttcacagatgcaattaggattatgcatctgtgcataatagggagattagcatggagcatctgggtacacccaatctaatcacatgaactcttaaaagcagataattttctccagctagagtgccagattccaagcaagagaaacactcgatgtccattaccggctttgaagatgaaggggaccagagacctcatggtacaaccacaaggaactgaattctgctcacaaccagattgaacttggaagtggatttttcccttgtcccttcagataccttgactttggccatgcaagtccttacacagaagacctagtcatgtcacgccggactactgacccacagaaactgtgagataataaatgcgtgttgtttgaagctgt

SEQ ID NO: 37458 - DNA, 101 bp, Homo sapiens
gaggcaggaagaatcgcttgaactcgggagggggagattgcagtgagccgagatcatgccattgcacctcagcctggatgacaagagcaaagctccatctc

SEQ ID NO: 37459 - DNA, 251 bp, Homo sapiens
catcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttggg

SEQ ID NO: 37460 - DNA, 482 bp, Homo sapiens
attttcaaaacttttaagatgaataccacatactttgctgctatcaaaatctgttttaggaaaccaataaataatagtttgaaggaattatttgggactatttttattacaccttttgatagcattgctctgacctttgtgtttattttgcttgagtttaagttgagtttattttgcttaagtttggtataaccaaacttatttgtgggttctgtacatacagaaatgaggaattatgtagagattttttaaaaccacaggctttatgtggaacaataattctgacttgaaggttagaactgaataccacaagttaattaaatattttttgtattttattgtgtaaaatatgatcgattctaggagccactaccaatgagaaagaaccagttgttttgttcttgggctataaaaacttgttccagcctcttttttgtcacatgtcctccctatattcctaaactgcttgttgtttttattct

SEQ ID NO: 37461 - DNA, 463 bp, Homo sapiens
ggcttccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactaca

SEQ ID NO: 37462 - DNA, 103 bp, Homo sapiens
  misc_feature 7, 9, 26, 27, 31, 37, 54, 78, 96: n = A,T,C or G
ccggccncntatgggcccggggaaannaganaaaganctctcttagaataaaancaaacgaagtagtcgcaagacacntgctcagcaaccctagangatgccc

SEQ ID NO: 37463 - DNA, 174 bp, Homo sapiens
catgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttct

SEQ ID NO: 37464 - DNA, 174 bp, Homo sapiens
gggaggagggagagcatcaggaagaatagctaatggatgctgggcttaatacctgggtgatgggatgatctgtgcagcaaatcaccgtgtttacctacgtaacaaacctgcacatcctgcacatgtacccctgaacttaaaatagaagttggaaatttaaaaaagccttagaac

SEQ ID NO: 37465 - DNA, 463 bp, Homo sapiens
gataggcagtgtctttgtttttctctggacaattttaattgaaataattcagacttagataccattcagaaaagatatatattaaaatatctttattagcatcaaacaaagcagtagtgagaaaaaaagaaaaatctttagtaagatcaaggaaaagtgaacgtacaaattcggatgaaaaaggagaaacaaccatagatagagcagagatgaaataatgagaggattctatgaaaaatgttatggtaatagttcgctgcaacctggatggggttggagaccattattctaagtgaagtgactcaggaatggaaaaccaaatattgtatgttctcacttataagtgggagctaagctatgaggatgcaaagtcaaagaatgacacaatggactttgaggactcgggggaagactgaggggggcttaggcataaaagaccacatattgggttcagtgtacactg

SEQ ID NO: 37466 - DNA, 481 bp, Homo sapiens
caagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggt

SEQ ID NO: 37467 - DNA, 314 bp, Homo sapiens
  misc_feature 313: n = A,T,C or G
gaagaaaagaggaagaaggagaagagggaagaagaagaaggagaagaagacgaacgaaggaggagaggaggaagaagaggaaggaagaagaaaggagaagaagaaaagaagaaaaggaagaagaaggagaagaagaagagaagaaggagaggaggaagaagaactaagaaggaagagaagaaggagaaggagaagaaaaggagaactaagaaggaagaagaaaggaaaagaaggagaagaagaaagaactaagaagacgaaggagaggaagaagaagaagaagaaaataaggaacaagaaagaaggagaagang

SEQ ID NO: 37468 - DNA, 317 bp, Homo sapiens
gggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattgg

SEQ ID NO: 37469 - DNA, 439 bp, Homo sapiens
  misc_feature 423, 433: n = A,T,C or G
ggctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaanaaaaatactnttaacc

SEQ ID NO: 37470 - DNA, 154 bp, Homo sapiens; identical to SEQ ID NO: 30916

SEQ ID NO: 37471 - DNA, 294 bp, Homo sapiens
  misc_feature 291, 292: n = A,T,C or G
ggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacnnga

SEQ ID NO: 37472 - DNA, 355 bp, Homo sapiens
atctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaact

SEQ ID NO: 37473 - DNA, 500 bp, Homo sapiens
  misc_feature 5, 8, 40, 43, 44, 49: n = A,T,C or G
ctttnctncacaggatgcctccttctgtgcctataagcancanntaggnggaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacaca

SEQ ID NO: 37474 - DNA, 462 bp, Homo sapiens
gaggcattgaggcagccagcgcaggggcttctgctgagggggcaggcggagcttgaggaaaccgcagataagtttttttctctttgaaagatagagattaatacaactacttaaaaaatatagttaataggttactaagatattgcttagcgttaagtttttaacgtaattttaatagcttaagattttaagagaaaatatgaagacttagaagagtagcatgaggaaggaaaagataaaaggtttttaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttggaaggcgatcttttaaaaagagatt

SEQ ID NO: 37475 - DNA, 157 bp, Homo sapiens
  misc_feature 25: n = A,T,C or G
agatagatagatagatactgtgaancccagtgctagagtgtttatatttaataagtaaagataggtagagtatcggaacaaaaacagcatgggaaactaacaattttggggaatgaatgagtaatcaggattcaaagcaagtatcaaatgagtcggg

SEQ ID NO: 37476 - DNA, 392 bp, Homo sapiens
  misc_feature 22, 24: n = A,T,C or G
tatggccgggacaccacccagnanaagaatagagcatctccatttataaagttccttcatgctccttcccagccagcaattcttcttactgtcctgctgactcctgttttcaccttcatcaccatcagctcattttgcttgttcttgactcataaacagaatcatatagtaggtggttcgttcaatgtaggcagtctgtttttgctttaatcattacatgagtatacatccatattgtgtgaagcagtagttcttttgcattgctgtgtaatattccattgtataattgtataaatatatgttgtataaatgtaagtatagcacaatttattcttattggacatcttgtttatttctagttgttagctagtataaataaagcttctgtgagt

SEQ ID NO: 37477 - DNA, 222 bp, Homo sapiens
agagaaaatattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggcagaggggtccttccatgttttctccagcctgggcaacaagagcgaaactccatctc

SEQ ID NO: 37478 - DNA, 463 bp, Homo sapiens
ggttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcgggagctggagaagtggctgaagaaagagccagaggcctttgactggtc

SEQ ID NO: 37479 - DNA, 111 bp, Homo sapiens
  misc_feature 92: n = A,T,C or G
gggtggtcattacttttatcttcttgattttatttttttaaatgtctttaatggtgattttttttacttttataattaaaaaaattaaaagngacaacatatatgtatagt

SEQ ID NO: 37480 - DNA, 457 bp, Homo sapiens
ggaacatggtttctcagatagggtagtggaaatagaatagtccaaaccttgatgcctgggaaatgagagcctacgaatctaatagtaacatttgagtaataaatcctaaaactcaccagggaccaccttctgctcccagttatcgttagcagggataatctgctgggtattcaactgtttagaaagaattgctggttgtctagttcttctgtggcacctcatttaaaagctggtttattatttacaggaatacaggaataatgtattagatcataaacatacagttcccataaataatgcagcaagaaagccaaatataaaagtctcagatgaacaactgaacaaccacgacctaataaaccagggatacttaatgagaaaaagcaaaattctacaatatagaaataataatgggggtttcatttgaaatgctacagggagtacagcactcataatt

SEQ ID NO: 37481 - DNA, 469 bp, Homo sapiens
  misc_feature 8, 39: n = A,T,C or G
caccggantgttttgtggttgggaaagaaccaccaaagnatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaat

SEQ ID NO: 37482 - DNA, 383 bp, Homo sapiens
ggtaaaatcactggcatgttgttggagattgataattcagaacttcttcatatgctcgagtctccagagtcactccgttctaaggttgatgtagctgtagctgtactacaagcccaccaagctaaagaggctgcccagaaagcagttaacagtgccaccggtgttccaactgtttaaaattgatcagggaccatgaaaagaaactcgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaac

SEQ ID NO: 37483 - DNA, 413 bp, Homo sapiens
  misc_feature 27, 193: n = A,T,C or G
atcccatataatgcttagcttccaagnaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcncaaatgtgcagaatagatacatcagttggtgcataatcgaaaaaaataggaattttgaacactgttctcccttctacatttatttctcttcattttagaatcacactttttatgttaaaccagattattattattattaattattcaaccagtattaagttgttaaaaccaagggaatggggccctaaccaaaaagaagtctcaactcagaaaaataagt

SEQ ID NO: 37484 - DNA, 464 bp, Homo sapiens
  misc_feature 27: n = A,T,C or G
atccactttatttttctatggataatnaagacttggctgaacatagttgaatagcacaggcatgaggtagaggttggtagaggataattttattttttattgcaatactcggaatactttgtatttgagtgccaaatgtatttgtattttagtaattaatctgtttatcatcttataaaaatactaataggcattatttctaaaaaatatagtgagttacaatgtaagtatcctaaagcaatatgaaaagaaaggattttttaacaaattatttgggaatcattaaatagcaatgtggaaaaaaaaatttatatctgtcctcataccatacaccaaaataagtttcagatgaatgtaaagattaaatttttaaaaatgaactatagataacttttagaaggtagactaggcagcggaagaaattacaaaggaaataatagacaatgatatagaatactttgttc

SEQ ID NO: 37485 - DNA, 464 bp, Homo sapiens
  misc_feature 17, 463: n = A,T,C or G
agaatagagaactcagnaaataaagcctatacctacagacaactgatctttgacaatgtcaacacaaacataccctgaggataggacatcctttacaataagtggtgctaggaaaattggattacctgtgcagaagaatgaaactggacttctgtctctcaccatctacaagccaactcaagatcaattaaaagcttaaatgtaagacctgaaactataaaaatactagaagaaaacctacggaaaactcctctggacattggcctagatgagcaatttatgactaaggcctcgaaagcaaatgcaacaaaaacacaaatagacaaatgggacttaattcaactaaagagcttctgcaaagcgaaaggaaataagagaacagacaatgtgtagaatgggagaaaacatttacaaactatgcatacaacaagggactaatatacaaggaactcaaacaactcanc

SEQ ID NO: 37486 - DNA, 366 bp, Homo sapiens
  misc_feature 14: n = A,T,C or G
gtttgcctcatggnagcgttatttataacgcaaaaaatggaaaaaaaacaaaaagccagctatctaccaaaagaagtatgactcagtgtattttggtatgttcacacattggaataagatgcagccataatgatgttgatgagaattagaataatgtgaacagtgcatgcatgtatgtaaaattagtgatacatgaatgtgtgatatatcattagtgatatatatgaacaaacgtgatgtttgttaaaatacagggataaaaggcatacacatttaatagtgattgctttcatattacagtaagaatgggtgattactctctttatatttttctgtattttcagtaagtatttattacttttatag

SEQ ID NO: 37487 - DNA, 456 bp, Homo sapiens
  misc_feature 10: n = A,T,C or G
cataccaggnaggaatgagcttggtctgacagtttctgcaagaacgctggaagtatgtaagtattgggtgggagtaaggggggatgtgatgtagaagtggtttcttcaaatgtttttatgcccttgccaaactcagaacttaaccatgataatgacattgtctggaggggtgtctaattttgctcaccatgagcagggaatggttgctgtgtaggagcaagtcctaattatagtgttacagaaactcttctcaagattagcagaggaaaacttaaaaccatcatgggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctct

SEQ ID NO: 37488 - DNA, 316 bp, Homo sapiens
actctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcg

SEQ ID NO: 37489 - DNA, 463 bp, Homo sapiens
agagtcaggagaccccaagcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggagaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagttt

SEQ ID NO: 37490 - DNA, 465 bp, Homo sapiens
agtgtaaagtgtcagcttacaaagagggagcatgatgtatttgtaatggatatataatgaaagaggaggtggagaaactacacctttcacctgggtgcagggagcactgaaagtgacaggtaaagttaaaggtggcaaggggttcataggtattgtgattgcctcctctccagcttggtcggctcatgcaataggaatggtcatcttaaataggttagtaggaaagccagaaaacaatggatgtttaccctggatgtcctttgaaacctggggtgggctcatgggtggaggcaggaaggggagacttactagactaggttgtccatgggcaacatatagaaacttaggagactgaaaatggtggcatggtatggttaggagggcgagacatgcagaagttcctggcagttcatgataagctggcttgtgaggaggatttctgaggaagatcaggtagattataga

SEQ ID NO: 37491 - DNA, 468 bp, Homo sapiens
  misc_feature 60, 222, 247, 301, 361, 423, 427: n = A,T,C or G
tgaattctggtgtttatcttggaaagtaatctgcaattctatatgacgttttttcctgcntaggacacgaagttctgctacaattatttaggaataactttttttatgactcatgttagtaatattactgtaaatcaacattttaaaaaaacaatgtttcatcaccataaaaaaaaaaccctccctccttcccacatcaaggatatcttcctcttgtctaanaagcacctactcctttttggaggtngacatttacatcgagcgagtacctttcatctctgaaaaagaaaaagaaatacgngtagaaaaacccaactaactaacaaatcaccttaattactacctgcagagaaaaagggtnggctttatgtttcttttttaattggggggggttttagctcaatccacaaatgagaaataagngttngggggaaaaacagagaccagttttgcttatatatggggggg

SEQ ID NO: 37492 - DNA, 312 bp, Homo sapiens
cagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgca

SEQ ID NO: 37493 - DNA, 471 bp, Homo sapiens
cattgaagaaagaaaaactgtttttaataaatttggcatagcttaagtatacagtgttcataaagtctacagcagtgtacggcaacgtcccagccttcccattcactcaccgctcattcactgatccacccagagcaactcccagtactgcaagctccattcatggtaagtgccctccattttttatcttttataccgtattttttattgtactttttctatatttagagaaatacttaccattgcattacaattgcctgcagtattcagtacgggtttgtagactaggagccataggccattccatatagcctgagtgtagtaggctctacccagtaggtttgtgtaattgcactatgatgtttatgctaataacgcatttcttagaacaaatcctgttgttaagtgacacatgactgtatgtttatgttgatccaggcaatcaggaaaagaaaatccatctgtgagcag

SEQ ID NO: 37494 - DNA, 464 bp, Homo sapiens
  misc_feature 22: n = A,T,C or G
gggttttttgaatacacagaanaagttgaccctcccatcttaaaacctgaaacttacatttgtctcatctgagttctttcctcaggaaaccgaccctcaggcaagcgactgaaactcaccagctcatggcatcaagaaaatgagccacaagacccctcatccatcataattgcttctgtatctctccctagtttctgttttcccacctctcccactatataagccctcaattttagccagtcaggaagatagatttgagacttctctctcatcctccttggctgccgcacccaattaaagccttcttctctggcaatactcattgtctcagtgattggcattctgtgtgaggagctatgggacctagaccaaaaccctggcattttgataacagcccccagccagagaggttgtgagatattctgcagctgccccaagttgttttagtatcagagggggtaaga

SEQ ID NO: 37495 - DNA, 464 bp, Homo sapiens
gaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaaggtgtggctttaggtgcagt

SEQ ID NO: 37496 - DNA, 163 bp, Homo sapiens
  misc_feature 2, 15: n = A,T,C or G
ancctcaacaaatgnaattttccccgtttgccctacgcccccttttggtacacctagaggttgatttcctttttcctcgatggtactactttcttagtgttttaaattggaacatatcttgcctcatgaagctttaaattataattttcagtttctccccatg

SEQ ID NO: 37497 - DNA, 288 bp, Homo sapiens
  misc_feature 11, 18: n = A,T,C or G
ggcacaatctnagctccnagctaagcaattctcctgcctcagcctccccgagtggctgggattacaggtgtgcgccaccatgcccggctgatttttgtatttttagtagagataggatttcaccatgctgcccaggctggtcttgaactcctgacctcaggtgatttgctcgccttggcctcccaaagtgctgggattatatatgtgagccaccgtgcctggctgaaatttttattaagtaaaacgtaagttcacttgctcattgccacagtcaaagaactaccatgg

SEQ ID NO: 37498 - DNA, 476 bp, Homo sapiens
  misc_feature 20: n = A,T,C or G
caagaaagccctcatttttnaacctggcaaaatcttgttaatgcccttgctaaaaaataaataaaagctagatactggaaacctaactgcaatgtggatgttttacccacatgacttacttactgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaat

SEQ ID NO: 37499 - DNA, 351 bp, Homo sapiens
  misc_feature 350: n = A,T,C or G
caagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaatnc

SEQ ID NO: 37500 - DNA, 470 bp, Homo sapiens
gattcttgttatccttcaactagcggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaaacagagtttagggaacctttgacctcttggaaaaagaactgccattgaggagtaatgcattctgttttgggagggaaaatcattttgttacttctttgaagggaggaggtataagaaatgaaatagaataatagagcagaaggtcagtgagccacagccctgcaggtagccagccactcttcttaggtggcggatgatgtttttgttttgattacagtaagaataaagtatcagctcttagatttaacttggggctcctaccttcaaaagcatgaagggccgtctcagaagagatgctgct

SEQ ID NO: 37501 - DNA, 465 bp, Homo sapiens
  misc_feature 11: n = A,T,C or G
catttcatttngggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgt

SEQ ID NO: 37502 - DNA, 473 bp, Homo sapiens
caggaggacttttattaagattgggacatattgcttagttagtctctagggtggaatcataattaatgaaagaactctgtctgatggaaggcttagtctaacaaatcatcctaaaacttcattagacattgtgtaatccccatggacactgttgaagagacacttgattaggcagatcgtgacaacttcagctttgcccatcatacatcctccagagactcctcaaactcaagacagactttctacaggaaggaatggctgtttctatttcagaatattactgataccagagctttgctgcatcttcatgtactttcctttatttttatttttatttttttacagacaaaatcttgctctgttgcccaggctggagtgcagtggcatcatcatagttcactgtcacctcaaactcctgggctcaagtgatcctcctgccccggccttccggagtgctaggattacaggagtga

SEQ ID NO: 37503 - DNA, 227 bp, Homo sapiens
  misc_feature 120: n = A,T,C or G
ggggggcggggcggactgtcccgcgacccccgtggactgcgtctaggtcatgtgattctgttttcatttctcatcccatccaatttgtccttttctcctgtcattttcttcctctgtggncccttcaaagttgttataatttgtactgaacttcaaaatgtgtcccgttctccccagaccactctagccacagtatattgcaataaaattacttcttatatttgcag

SEQ ID NO: 37504 - DNA, 101 bp, Homo sapiens
  misc_feature 6, 11, 13, 21, 56: n = A,T,C or G
caatcnacctntnaggccccncccctgggcccccttcacccgctggttggaaagantgttggtgttggctggggtgtcaaataaaagctgtgcttgggggc

SEQ ID NO: 37505 - DNA, 230 bp, Homo sapiens
  misc_feature 10: n = A,T,C or G
ggttgaagantgatatcttaaaagttgtcccttttaaatgagaaagtttagcattcaaggaaaagagctaattatcctgtttattgtgcatagaaagcacactcgaagatcttggatttttgtaagattgcaggctttcaaaattctgacagggctgcttctaaattcgtcaatgttgacggctgtttttttgtaggatgacaactggttggtgttgctccattttattg

SEQ ID NO: 37506 - DNA, 467 bp, Homo sapiens
gtgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggtttggataaatacatcagacattatattggttggtctacgggactatcaggataacaaagctgatgtaattttaaagtacaatgcagatgaagctagaagcctgaaggcatatggcgagcttccagaacatgctaaaatcaatgaaacagacacatttggtcct

SEQ ID NO: 37507 - DNA, 466 bp, Homo sapiens
atcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcattgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaagga

SEQ ID NO: 37508 - DNA, 100 bp, Homo sapiens
gaaaaaggtttagaacttggtaaaggtaagcctctactacaggttgattactcccttatctgaaacacttgggaccagaagtgcttcagattttggaatg

SEQ ID NO: 37509 - DNA, 194 bp, Homo sapiens
gatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactcc

SEQ ID NO: 37510 - DNA, 235 bp, Homo sapiens
ggatggatggatgtgtgtccaccaagaggcttagaaccaatgacaccccaatggcaatgagcatatcaagtgcccagatcttggctcctaaataccatattccattactactttactagaaactagggctccatgaataaatagatgattccagtgatagggcaagaaaacgcaagatgatcctaaatatgttgttctagaaaataagggaatgctcaatgaatggctggggacg

SEQ ID NO: 37511 - DNA, 471 bp, Homo sapiens
  misc_feature 386: n = A,T,C or G
attttttgtagaaatagagtttcactatattgcccagggtggtctcaaactcctgggcttaagcattccacctgccttggcctcccaaagtgctgggactataggcatgagccaccacacccagccctgttgggacatttttttatttactgacttaatcttgctgttcattattaatctgttcaagggctctatttcttcctggttcaaccccaggaggttgtatgtttctatccctctaggttttctagtttttgagcatatagttgttcataatagtttgataatcttttgtatttctgtggtatcagttgtaatgtctcccttttcatttctgattgtgtttatttggatcttctctcctcttttttagtctagctattggnttatcaattttgtttgtcttttcagaggagcaacttttcatttcatttttccttttatttttttggctctatttgataccttaca

SEQ ID NO: 37512 - DNA, 276 bp, Homo sapiens
gggcacggtggctcatgcctgtagtcccggcgttttgggaggccggggctggtggatcgcttgagctcaggagttcgagatcagcctgggtaacatgatgaaaacctgtctctacaaagaatacaaaaattagccatgtgtggtgccacacacgcatagtcccggctactggggaggctggggtgggaggatcgcttgagcctgggaggcagaggttgcagtgagctgacattgtgccactgtactccagcctgatgacagagtgaaaactctgtc

SEQ ID NO: 37513 - DNA, 309 bp, Homo sapiens
acagagcgccttctggtcctagcccgccctgtatgaccgcgcaaatatccccaaagcttttgggtcctcaagtcatgcccgaatttagatgctggtcattttctggagaggggtcccctccccttacgaacacagaaacccagcccacatgacaagcacgctgagctctgcagggaccagtgccaggcactggggggtggaagtgtggtgacacagtgaatgggaggtggaggagggttgcagctcccacctcagtttagtttttaattcagggttttcaacctgtaacacattaaagctgtaattatc

SEQ ID NO: 37514 - DNA, 329 bp, Homo sapiens
atcgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatac

SEQ ID NO: 37515 - DNA, 422 bp, Homo sapiens
  misc_feature 416: n = A,T,C or G
ctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacacttttgtgagaaccaatgggaaggagcctgagctgctggaacctattccctatgaattcatggcataataggtgttaaaaaaaaaaataaaggacctntgggct

SEQ ID NO: 37516 - DNA, 471 bp, Homo sapiens
  misc_feature 211: n = A,T,C or G
aactgccattcttcaagggctgtttttgtttttgaagaaactactcttaataataatgtagttggtgcagtgaatctgaaacataaatatcaatgatatttatctttatttaggaaaggaaatttttttttcctatagcatccggtagtttcatcgtctccctgtagccactgcctaccatattggactgtatttgggcagtggtaaaggngatatgcaattctgtagataatgctgtcagtaacgtgtaatatgtagcaccaggttataaaacacttaataaaaacacattaatatattcagaaaggttctaaaaatagaatgtataaatatgccaaaagtcttgcagttgtacagttggaacagcctttcattttctaagtattcttaatgtgctatgtattacacatttcataattaagattcaggggcatctgttgaattgttacattctattcagtgtaacaaaac

SEQ ID NO: 37517 - DNA, 467 bp, Homo sapiens
aatgaaaatttatataaagctagctctttttatgtagcttatatagcgattcatatataaagtgtagctatccttttcagttaatggcaacataatacaatattgacaaaggtgcagtagggtgaaactttatgtttcaagtagtacattcatgagcttataagacaatggggtttaaacactcttagccacagaagtaaggaaaataaggggaaaagaccttcaaaccttcatgtgcttcagactgacaaggcctctaaataactagagtggcccaaaacagtgcattttcatctttcacttaaccaaagccagtactcattttctagagcttggttctgaagcatcaccaaggtccaaagaaagattattctgtactagtatgacgaggtagacaggtgataaataagaaatggagatttattatgcctctggctgtttcaaagagggttctcttcattcaaata

SEQ ID NO: 37518 - DNA, 165 bp, Homo sapiens
tcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatg

SEQ ID NO: 37519 - DNA, 428 bp, Homo sapiens
atccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcggaaggaaaggagaatgttttgtggaccactttggttttcttttttgcgtgtggcagttttaagttattaagtttttaaaatcagtactttttaatggaaacaacttgaccaaaaatttgtcacagaattttgagacccattaaaaaagttaaatg

SEQ ID NO: 37520 - DNA, 332 bp, Homo sapiens
atcctacctgagcttggaagggatgagtttggtagacagagaatgggatcagaagcctccatcttggcccctgagtttgctggacaaagatatcgtgggatgaaaagtcttcttgttggtctatgagtttggtacacaaacataatggagatgaaacctcggcaacatagcgagaccccatctctacaaaaaaaattttaaaaccttgtgtggttggcatgggcctctagtcccagttacttgggaggctgaggtgagaggattgattgaactgagaaggtcagtgaactgtgccactgcactagtctgcgtgacggagggaggcctgtcgc

SEQ ID NO: 37521 - DNA, 279 bp, Homo sapiens
aatgtgagccaagtgtagccttccaggctgagtgggtggagcaagcccagcaggcctgagcaaaacttgggcaaaagcaccaccacccacagaggtttctggccagaaaagcaacaccataaggttcctgaaacaacaggtcccacaactctcttcacttttttcagcttattttctctttcatgttcagctagaataaacaggaagttctgtctttgtcactgaaatttttcctctgtattatacattctactattgagccaatacacttttattctg

SEQ ID NO: 37522 - DNA, 472 bp, Homo sapiens
attctagactgagcgcatccataggcaactaaaactgtatggtactgtaaggagactagtcagtcagtctccttaaatctattctcacctcagtccattctgaatagagttaccagagtgaaattctcttagtagtgttcttatgttattttcataaagcgtacagtggcctagatggctttagacttcaggattctttaccatctagccccttttactctaccaacttattttgttacttgttgacataatctgtagccaggaaagcctgcatacagtttgttatccctctgtctttgctcatgcgttttctgcatctggaatcatcttcctctcttctctctgctggttcatgtccctattttctttcaaaactctctttgaaatttacatttttcaggaagcctttctctttggcttgctggacatctgaccggcatgttatcttttcatatttgttcaaaatgtcatt

SEQ ID NO: 37523 - DNA, 462 bp, Homo sapiens
actcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggcca

SEQ ID NO: 37524 - DNA, 464 bp, Homo sapiens
tcaaacacctgacctcaagtgatctgcctgcctccacctccccaagtgctgggattataggtgtaagccaccgggcctggccggatacatttttattatcaagtatatattttaggaatgattagtgttggtttagttgaatagattggtacaattagtagtaatttgaaatgatgcctatggtttcctaacattttgtcttagtgttgattaaagacataataatgtgaaataatatggtaatactaaggaatgagaaagtggccttacaggtgggcaatgtaaactttcctgtagaaggattgaaagtaaatagatgtaagactagaaagtgaaacaattctgtactgtaagagcaatgttggctgtgttaaataactcgttcccaaacatcagatccacctggggagcccaaatatttacctacatttttggagttcttaggggctgaaacttacgcttgt

SEQ ID NO: 37525 - DNA, 263 bp, Homo sapiens
agtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaagggaaaagggcaaatacaaggaagaaaccattgagaagatgcaggaataaagtaatcttatatacaagctttgattaaaacttg

SEQ ID NO: 37526 - DNA, 207 bp, Homo sapiens
  misc_feature 207: n = A,T,C or G
cattgttaagttctgataagcagcattttgaacatatagtcttattgcctggtttaatcatgtacctagatttctggggtcgtcctttaaaacttaagttgtctcccaaatcattcctggtaatgcttaactctgacatttttgtgtaattatttgacagaatatgtggattttatacttttaggacagttttagaagacgacagan

SEQ ID NO: 37527 - DNA, 462 bp, Homo sapiens
  misc_feature 23, 82, 290: n = A,T,C or G
aagatagtgatatctttaacagngagagaaatagattcgagtaaaatgctaaaatttattttagacatcttatttttaaggnggcatcagactatccatgtggggttgtgtaggaggccctaagaaattggggtcttcagctcttaggagaggttggttttagaactgtagatttgggagtcattagcatattacttatgatgatgctaaatggataaaactgcccagagagaaaatattcaaatagaaaagagtagagggcagaatcaaggaaatttatatcatttgcntggtggttctaaaaaggacaaagtaacatctgtctattgcctttggtcaaccagggttaggattcacaatccaattaatcagttttgcttctgttcttattaactgagctaacctagcaaaactggggctggctgaatggctctacctggttgaaaaaccaggattaggtag

SEQ ID NO: 37528 - DNA, 460 bp, Homo sapiens
gtggggtgctctccaaaggcgagccagcctgcatgttccttttcattgagagatgactggaaatatagaaatgaggggtgtcacctccattgaaagaatgggtggcagatataaggcccaaagtccttttcttttagagtttagatctaatatgacagattagtccttatttctcgatgctgggaaacactgacagaaaccatgctaagacgcagggaaaaggccaataagagatagtttaaatctctctctgctatgtgtcaaataaaaagtaaataaagaggctacaacccacttcaggcttgatcagaaagtcattgccggtaaatcatgcagtgttgtgtcacacgtttgttcattttcatatctattcatccatcctgtggactctgaatgacagcacctaaaatacaaaacgtctccatgaaagggtttaaaaattagagaaaacattggttag

SEQ ID NO: 37529 - DNA, 445 bp, Homo sapiens
gattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagcttgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgactttgtagtaactgccaccaataaagcagtcttta

SEQ ID NO: 37530 - DNA, 461 bp, Homo sapiens
catcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgggacttgcatttatccagacaaaaaatctgagggagtaagaatttcatcatggccaaaggagaaaccgggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgt

SEQ ID NO: 37531 - DNA, 168 bp, Homo sapiens
agggtgagagtggttccccgggtgagaacggatctccgggcccaatggtaagtatggacaccctccaggaaggtttatcaaagactcttcagactatcagatggctgcaaagagctccctttgtgcaaagttcatattctgtgttgtagatttcatctgattgtgagc

SEQ ID NO: 37532 - DNA, 464 bp, Homo sapiens
ctcaacaaccgattgagacccttcttactcctgaaggctctagaaagaacccagctcgcacatgccgtgacttgagacttagccacccagagtggagcagtggttactactggattgaccctaaccaaggatgcactatggatgctatcaaagtatactgtgatttctctactggcgaaacctgtatccgggcccaacctgaaaacatcccagccaagaactggtaggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatga

SEQ ID NO: 37533 - DNA, 104 bp, Homo sapiens
  misc_feature 102: n = A,T,C or G
gttgaggatacaaaatcgtgcaaaaaattaattaaatttttatatgctaacaatgaacaatctgaaaagcaaattaagagaataatctcatttacaatagcntc

SEQ ID NO: 37534 - DNA, 467 bp, Homo sapiens
attattgtcactgttaataatggccctttatttgagctttgctaggacaatgctctaaacaaagctgagaggaagaaacagtccctgctgtggggccttgtaatttatcaaggctaatggaggaagaaaaatccactggggaaagattgtgggggtgggctggcgatagatttgattgttgctggaggtgtaattggacgatacccacagcctagctatgcatccctatttgctttgttgcaacaggactgtgtttctagcccctcctttgtcttgtctagttccgctggatctgagtcccttgaaggcagattgaggtctaagtcctggatctgatgtagcagcatgacctcaagcgggttcctttacatctgagccttaggtttcctcgtctgcaggggaggtacccagattggaaatcatgagagtccaagccccttaaattgctaaaggaatactagctgcca

SEQ ID NO: 37535 - DNA, 473 bp, Homo sapiens
  misc_feature 213: n = A,T,C or G
aagaggaagatgtggaaaatgtgatgtaatgggatgggattggacttaatatatagaaaaaagaaatgctttaggagccagatcttttgaataagatgtatcattgaactaagcagtatacattttagtttaaaaaaataaacagtatatctttaagcagggttattaataacagaatacttgaaggtatatttgtatcatattatgaatacntgcttttcattaacttactgcctgtattgatttgaaccataatgtggataaaccaaaaggagaaaaacaataatacacaggccttcagtaggaaaaacggtaatatacatgttgagagaagggttagaaaggacgtcttagtaaaacatggtctgatttttatcaatctagagtgggaagactcttattctcttttctccacatttagcccagaaatgcaggttgggggaatagaaatgatgcctaaggctccttgctga

SEQ ID NO: 37536 - DNA, 159 bp, Homo sapiens
cttaaaaggggggtgtagtagaaaaaggattaaaatgaaatactgtactggaaaatgttccttgggtagtaggaatatgggtatttttaaaattctttctgattttctacattttcagatattttataataagtatatacactacttttataatattac

SEQ ID NO: 37537 - DNA, 217 bp, Homo sapiens
cacatttggatgattgtcataaggtttttagcatgttcctccttttcttcaccctcccctttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatcctgc

SEQ ID NO: 37538 - DNA, 286 bp, Homo sapiens
  misc_feature 212, 219, 253: n = A,T,C or G
ggttctgatttgattttttttttcttctgcctaccctttttttggaagtttccagccgcaatttgaaatgaaatgacaaggggtatatttgatcaattttcattcccaccattgcattacaacctctaacttaaatgggtaaccctaaggcatatcaaagaagcagattgcatgataaacggaaacagaaaaaaagaacctacatttatttngctttancatccttactctcaccttttatgagattgagagnggacttacatttccttttttacattttcgtata

SEQ ID NO: 37539 - DNA, 230 bp, Homo sapiens
  misc_feature 227: n = A,T,C or G
ggatcacatgaggtcgggagttcaagaccagcctgaccaacatggagaaaccctgtctctactaaaaatacaaaattagccgggcgtggtggcgcatgcctgtaatcccagctactcaggaggctgaggcaggagaattacttgaacccaggaggcggaggttgcggtgagcagagattgtgccattgcgctccagcctgggcaacaggagcgaaactctgtctcanaac

SEQ ID NO: 37540 - DNA, 271 bp, Homo sapiens
  misc_feature 11, 47: n = A,T,C or G
ggaggaacagnacacttaggttcatgaaacagagtagagaacccagnaaacaggcctacacagatatgcccagctgatttttttgacaaaggtacagaagcaagtcggggaaggtcagcctttcaacaaatgatgcgggggcacctgggcatccacaggcaaaacaatgaacagccaccaaaggctcacacttttatacaaaaattaacttaaaatggatgatggacttaaatgtaaaatgtaaaacatagtatttttttaaaatgggaga

SEQ ID NO: 37541 - DNA, 426 bp, Homo sapiens
gctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttg

SEQ ID NO: 37542 - DNA, 183 bp, Homo sapiens
agcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagac

SEQ ID NO: 37543 - DNA, 366 bp, Homo sapiens
  misc_feature 7: n = A,T,C or G
ggggagncgaatcccgcttcaccctttcctctctgctgcgtcctcggcaagcaggttttcacgtctgcgacaaggtggtctcagagtggaattgcattcttacaagtcaaggaacatgattcggagaggaaaagctattcgcttttataattagctcaaggggtttggaaacattttgattaaaaaaaaataatagaggtggggacaaatgtgaatctaagctcagatgctatgagtgtcttgggccagggatagcttatctttgtgtcttctttggaaggggctcagatggatctagattaaggatgaattgcacggccgcagtttagagtgaaaggatcagatgcaataattatcaacattagc

SEQ ID NO: 37544 - DNA, 177 bp, Homo sapiens
attgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaag

SEQ ID NO: 37545 - DNA, 240 bp, Homo sapiens
atcgtgcccagtcctcagtgtgataggggctttttaacaaaatagagagcagctggttacagttagaatgaaataaatgtcatcaaggaaagactgctggcagtatcttggggtgggttaccacactccagagtttagttctgaactctgagatttagaaactctattttataagtatacctagagtcgatcagactatcaagaaaagacttttgctaaccagattcactcacccatgcg

SEQ ID NO: 37546 - DNA, 460 bp, Homo sapiens
agcctcccgattagctgggactacaggcacccgccaccattgcactcctgcctgggcaacagagcgagtctcaaaaaaaacaaaacaaattgacacatagtgtcacttggtaaatgacagttattgagatgaatacagtcagttctctgtatctttggggtccacacctgtgaattcaaccaactttttcttttcactccctaaacactacggtataacaaccatttacatcgtattagctattttaagtgctgtagacatgatttgcaatataggggaggatgtgtgatggttgtatgcaaatactacgctgtttcatataatggacatctaggcggggactggggtttcctgaaaccaactgtgcgttacatcttcagaagctttttcagttcctttcaagcctgttgcttaggttgcgcagtctacacaccaagacaagggcattcctctgcgggag

SEQ ID NO: 37547 - DNA, 464 bp, Homo sapiens
agaaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagacgcatgcgctgctggccattgccctcacgatgtaccccatgcgtatcgatgagagcattcacctccagct

SEQ ID NO: 37548 - DNA, 461 bp, Homo sapiens
  misc_feature 147: n = A,T,C or G
attcttcagcatttgaattctgtcaagttgactgcaacctctctctttttctctctggctccccaccccctccttcccttggctctctgcttctccctccccacccttggtgcagaggaggctggcagctgtgtgcaggatgggcangaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataagtaaattacttgcaagcactgcaaacacgctcccatagatgctggtcgtctctgcaaagcagaggggctagttatccatgggacctggtagctggggtagaaagga

SEQ ID NO: 37549 - DNA, 342 bp, Homo sapiens
  misc_feature 33, 44: n = A,T,C or G
cagggcttgaagcctcatctaaagacccaaatnacagcacagcntttgaaagtgatagagtcagacactcacaggacaaatacgccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcaggaggggcccgagagttctttgacagcaaccgggaacttcctg

SEQ ID NO: 37550 - DNA, 469 bp, Homo sapiens
ggtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattt

SEQ ID NO: 37551 - DNA, 221 bp, Homo sapiens
cacttgaggtcgggattttgagaccagcctggccaacatggcaaaaccgtgtctctactaaaaatacaaaaattagccaggtgtggtggctcacacctgtaatcccagctacttgggaggctgaggcacgagaattgcttgagtccaggaggcagaggtttcagtgagccaagatcatgcccctttactgcagcctgggtgacagagtgagactccatcac

SEQ ID NO: 37552 - DNA, 386 bp, Homo sapiens
  misc_feature 13: n = A,T,C or G
atgaagtaatttncaagcattctgtttatccttaaaatgatcctacaaataaatataaatgcaggtaatgaatctgttgttcaggaggtgaaataacttaccccaaatcacttagcctttaaatggagggcctgagccccgaatccctgtcggctgtgtctgtatctctgagtgttattcttcatgttacctcagtttacattgcactaagtattagtgtctactttgtctgaaagggggattagaacatgttgttagggccaagcatggtggcccatgcctgtagtcccagcactttgggaggctgaggcaagcagatcacttgaggtcaggagtttgagaccagcctcaccaacatagtgaaaccccgtctctactaaaaatac

SEQ ID NO: 37553 - DNA, 471 bp, Homo sapiens
aacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgt

SEQ ID NO: 37554 - DNA, 381 bp, Homo sapiens
cagctctgaatgaggaggggagaagcccctgggtctttctttgaaaggaatccgctgcttgagggctgtctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaaga

SEQ ID NO: 37555 - DNA, 148 bp, Homo sapiens
ataagcccttttctagaaaacagccgggaaaccttctttaaaagacacgtgaggcaaacacggccatttggtttcagaacagaggcagacgtggagtctgtggatcatcaggtcttccctctgctgtgtggcccacagactgacccag

SEQ ID NO: 37556 - DNA, 184 bp, Homo sapiens
  misc_feature 2: n = A,T,C or G
angtgaaaccctgtctctactaagggtgcggaatgttggctgggcgtggtggcatgcacctgtggtcacagccgctcaggaggctgaggcagaagagtcgcttgggcctgggaggcagaggttgcaagtgagctgagatcgcaccgctgcactccagcctgggtgacagagcaagacttggtcc

SEQ ID NO: 37557 - DNA, 289 bp, Homo sapiens
tagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagac

SEQ ID NO: 37558 - DNA, 385 bp, Homo sapiens
ggagctttaatttattaatgcaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcct

SEQ ID NO: 37559 - DNA, 189 bp, Homo sapiens
ggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgac

SEQ ID NO: 37560 - DNA, 267 bp, Homo sapiens
  misc_feature 22, 37: n = A,T,C or G
gtaagggtccagctgatcaagnaatggcaagaaaatnacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatg

SEQ ID NO: 37561 - DNA, 259 bp, Homo sapiens
gtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagt

SEQ ID NO: 37562 - DNA, 267 bp, Homo sapiens
  misc_feature 164: n = A,T,C or G
gaggaacaatggaaactattgcttttttcactttatgaacaacatatcaacaggatagtctttctcatttctgggagatatactttaacatttgtctatgggaatatttttttttaagttttcaaattacttcaagcttttaagtaattttggctgggtgcggnggctcacgtctgtaatcccagcactttgggaggccaaggcaggcggatcacgaggtcaggagatcgagaccatcctggctaacatggggaaaccccgtctcta

SEQ ID NO: 37563 - DNA, 123 bp, Homo sapiens
aggagttgggtacatttggttcaagtgctgcaatctgtatgtactaaatagctttactttgtgtatgtgtacttataatgtgtagatgtactactacccaggttttgtcaaatcatctttttt

SEQ ID NO: 37564 - DNA, 285 bp, Homo sapiens
attgcagattttcaagtagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgc

SEQ ID NO: 37565 - DNA, 275 bp, Homo sapiens
  misc_feature 211: n = A,T,C or G
aagaaacagcccggttttaggaaaggacttcccagggaggtttagtaagccagctgggagaaaggaaaaaaaacgtatttttagggagggatagggacgctcccattgtgcaagaaggaagtatagccggttaacagctccatcaagttctactagaaggagtgcctatgtaaatgaaattctgcttttaaagtgcctattatataaaggnctctagaaaactcaagccctgttctacaagccctagcagcctgacaattcactaagcataggag

SEQ ID NO: 37566 - DNA, 469 bp, Homo sapiens
gtatcctgggggtgtgtgtgtgcatgcatgtctgtgtgtctgtctgtccatgcacacatacacttgcccaggagactaagggatgctgaccaggagaaggcagccaccaagctggaggtgaagtcaggtggacaggagctgggacatctaaaccctagatctggcccctgtcccatgtccatagtaaccccctcacccactctccttctcaagtggatcaggggctatttacaacactcctcccctgtctctctgggtatatgtatgtgcagtttcctcttgctgaaatgcccttcatttcctctctcctcctggaaaatgcctgtctatccttgtgtgagggttcagaggctcagaaaccccttctctgggagggactctcctatctgccaccccttaaccagctcccactgtgcctcctccctcatctggcacattaaattattacttgcaaaataggcacagtggt

SEQ ID NO: 37567 - DNA, 123 bp, Homo sapiens
  misc_feature 112: n = A,T,C or G
agctgtgcgggatactgaggcaggagaatggcatggacccgggaggtggagcttgcaagtgagccaaggtcgcgccactgcactccagcctgggcgacggagcgagactgcnaaaaaaaaagg

SEQ ID NO: 37568 - DNA, 466 bp, Homo sapiens
acataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttattt

SEQ ID NO: 37569 - DNA, 392 bp, Homo sapiens
  misc_feature 281, 367: n = A,T,C or G
aagaaacatgtggatccttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggntcagtaagcactccttaactccttagtatttcatagaaaaatgactgcaacattaaagctaagaggaacacttcaacatatgtggnacaaatttatattgaagatctaaat

SEQ ID NO: 37570 - DNA, 207 bp, Homo sapiens
gctgctgttactgcctaacacttatggcagtctggcagcacctctaatctctgccatagcagacaagccactcacctaaggcctctgctgtacttccaaagaaagaatttctccagtagagactgagtggaactagactgccagctgtgagcctcagagctcctggctgcctgttgctgagtctattagctgctgagcctttctcac

SEQ ID NO: 37571 - DNA, 467 bp, Homo sapiens
  misc_feature 1: n = A,T,C or G
nagcatggatgaatctcaaaaactttatgctaagtaaaataatccaataataatagactatatactgtatgagtccaattatatgaaattttagaaagggtaaacccttaaaacagaaaggaaatcagttgttgccagggtccagggttaatgggtaagggattgatgcaaatagatgtaaggaatattctggaggtcagagcattttaatatttttatttgtcaaaatttttacaattgattcttcaagtaagtaaattatatggaaactatacctccttaaactgtctaaagtataattgagacacccacatgcaagaaactgaatgtacacatagaactcccatttttcacaaaaaataatttaaaatgaatcatagacctaaatatataatgaaaaattaaaaactagaaaatctagatgatttgagtatagcaatggctttttgaatgcaatatcaaagata

SEQ ID NO: 37572 - DNA, 429 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgct

SEQ ID NO: 37573 - DNA, 368 bp, Homo sapiens
  misc_feature 210: n = A,T,C or G
agattcagccatcaccaactgtgctctgtcctacaaaggggctttctggtacaggaactgtcaccgtgtcaacctgatggggagatatggggacaataaccacagtcagggcgttaactggttccactggaagggccaccgaacactcaatccagtttgctgagatgaagctgagaccaagcaacttcagaaatcttgaaggcaggcgcnaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacg

SEQ ID NO: 37574 - DNA, 226 bp, Homo sapiens
  misc_feature 219: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtancatgagg

SEQ ID NO: 37575 - DNA, 352 bp, Homo sapiens
attgcagtgaataaatggcatgcatctttgttagagcaaagaagacaatacttccagtggtgggaaaaaaccttgtttatggcagcataataacgttgctttattttcagcagagggatagagacatagagaaaagagttagatttagcaaatacagaacatttttagaaaggtattgtcatagagttgtagattagccggtttcaaagtctgttttccatttgcttggctttctgccaagagttagttgattgactcaaaaaccagccactaggcttgttggaggcgtttcccatccatcccaggggcccctctttatggatttattttgtttttgtgtaggcaccgtaga

SEQ ID NO: 37576 - DNA, 452 bp, Homo sapiens
  misc_feature 95: n = A,T,C or G
catgctttgggtccttcctaatacttttatatttgtaaatcaatgttttggagcaatcccaagtttaagggaaatatttttgtaaatgtaatggntttgaaaatctgagcaatccttttgcttatacatttttaaagcatttgtgctttaaaattgttatgctggtgtttgaaacatgatactcctgtggtgcagatgagaagctataacattgaatatgtggtttctcttacgtcatccacctcgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatg

SEQ ID NO: 37577 - DNA, 461 bp, Homo sapiens
atttgtaggtaggattatctcttgattggtctttgttcacatgaggtttacaacatatgttctttaggttttttaaatggaattttttattgacataattgtagatttgcatgaagttgtcaggagtaatagagatagcctgcataccctttatccagtttcacccaatggtaaatcttacaagtttacagtacaatatcataaccaggatattgaaattgatatagttcatgtcattcatacaagctaccgattttatgcaaatacgctttttaatttttatgttttgagacagggtctcactctgtcactcaggctagagggcagtggtgccatcatggcgcactgcagccttgacctcctgaggcaggagaatggcatgaacccgggaggcggagcttgcattgggccgggatctcgccactgcactccagcctgggtgacagagcgagactccatct

SEQ ID NO: 37578 - DNA, 312 bp, Homo sapiens
  misc_feature 284: n = A,T,C or G
gatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatattgnggcactttaaaaaatccatttcttttag

SEQ ID NO: 37579 - DNA, 332 bp, Homo sapiens
  misc_feature 97, 120, 159, 265, 270, 294: n = A,T,C or G
catttcatttcagggtcttggctgcctgtgggcttccccaggtggcctggaggtgggcaaagggaagtaacagacacacgatgttgtcaaggatggntttgggactagaggctcagtggngggagagatccctgcagaacccaccaaccagaacgtggnttgcctgaggctgtaactgagagaaagattctggggctgtgttatgaaaatatagacattctcacataagcccagttcatcaccatttcctcctttacctttcagngcagnttcttttcacattaggctggtggntcaaacttttgggagcacggactgtcagttctctggga

SEQ ID NO: 37580 - DNA, 456 bp, Homo sapiens
  misc_feature 1, 17, 25, 42, 450: n = A,T,C or G
naagtaaaaggaaaagnaagtaagnaaacacaggatcgaagnaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcntccttt

SEQ ID NO: 37581 - DNA, 373 bp, Homo sapiens
caaggaaaccaggggacctagcaaagtagtctggagaaaatggccaaaggaattctgacattccatacctgaatgaactgttttcgtgagtgctttgatcaccctatcccctatcaaggcgctgaacaggtggcccgcaggaaatctgctgtcgcaagaggagggctttgacttacttcccctaattgttgagtaaaaagtgattctcttaatttctgtattctgtttttcatatcaccagtagaagggtcctgtggatctaaatagagcacattttaaggctacagagtagtagaaattgatgtttagacaaggcagcttgttcaaaatctgaaaggcacacccagaagctttctctaaacattttggctcc

SEQ ID NO: 37582 - DNA, 119 bp, Homo sapiens
  misc_feature 99: n = A,T,C or G
ataaacataatttataatttagaaatacttatttctgctttttttcctagtgtttatcttcctatttgtatctttttttagctcccatagtctcttgtncttttatttaaacttttcct

SEQ ID NO: 37583 - DNA, 399 bp, Homo sapiens
  misc_feature 366: n = A,T,C or G
acatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagntatgttaagattactaaaacaataaaagctcct

SEQ ID NO: 37584 - DNA, 462 bp, Homo sapiens
  misc_feature 17, 23: n = A,T,C or G
agctcacagttaaaatntacagnaaagagtaaacattgaaagcctttctacaaagatctgtaataagataaggaagcccactttcaccatatgtattcaacagagtactgggaatcctagccaaagcaattaggcaagagaaagaaataaaggacatccaaattggaaagcaggaagtcaaattattattatttttttttgcagaagacttgatcttatatttagaaaaacctgaagactctgccaaaaaacttttagaactgaaaatttgtaaaattttaagatacaaataacatcttagtaaaattacaagatacaaataacatataaacatcagtagtgtttctatatgccaacagagatctatctgaaaaagtaatcaagaaaacaatttcatttacaatagctacaaaaatatcaaaatacaaatttaaccaaagatgtgaaaaatctctgtgaggc

SEQ ID NO: 37585 - DNA, 445 bp, Homo sapiens
  misc_feature 56, 209: n = A,T,C or G
gagaagaagacgacttcaatcacataataaatgtgcatgtgttctaagttcaaggncctttccactccaagctctgaagagtctatggatgctgtcaatagatgtctcggcttgccacaaaacccactggaagtggatccggataatcaatctacctttgcaaatgtgatgctcaaaggacggctctctcatgggaaacaagaaatgtntcccttaatccaatactcaatttgctctttatttccaaacaacagatatacacgtataaacacaaacatatatcatgcctatactctttattatgccaggaccctggctctttcctgagctttcctcccataggttgatttctacttaggtaactgggtttttctatttctgcttaactaggagtgtttaagttctatgtaatattacatccgaatttgagtacccggatatatac

SEQ ID NO: 37586 - DNA, 470 bp, Homo sapiens
gacagtcctggctggagcagcgagtccgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgt

SEQ ID NO: 37587 - DNA, 469 bp, Homo sapiens
atcttcttcatggctgactcagtggttgggggaacctgatgatgaattattggtcaagcttgtttctcctgggagtgctcttccaagcatatttctgctgcctgcagagccacactgtcttgggccactggcaggtgggtgatgtgtggattggatcttctttttgtggctgtggacacctttaagcactgccttcctggccttcaaagcattcgctttggcttcagctttgggaggggcaagaacttttttcacttttggtgccataatgtgaaaatgaggacctatgttgagccctcactcctctagaagccagctgtgtgccctcggcaaagtcaattaatcactctgagcctcagtttttataatctgtatgaggcctactaagaatttctgcattataacccttgaagggccgcagctgatgatcccataaaagtgtgtgaggggccactgtgaatgaagtcca

SEQ ID NO: 37588 - DNA, 141 bp, Homo sapiens
gaggattaaatgaaaggctagagaacagtgctttttgagtgttatttaaaagtttcttaaataagtaaataaagcaaaagagaattgaagagaagtaatactgtattaaggtataatgtgtgagtttaatcccagttgact

SEQ ID NO: 37589 - DNA, 146 bp, Homo sapiens
gttttgtttttttcctttttcctcccctttgaccctattcatgtctctacccactatgcacagattaaacttcacctacaaactccttaatatgatctgtggagaatgtacacagtttaaacacatcaataaatactttaacttcc

SEQ ID NO: 37590 - DNA, 328 bp, Homo sapiens
gcatgcgcctgtaatccccagcccttgggaggctgaggcaggggaattgcttgaaccagggagggggaggttgcagtgagctgagattgctccactgcactccagtctgggcaacagaacgagactccatctcaaaaaacaaacaaacaaacaaaaatttgatgtcaaagtcccattgttaaaagtcttttacacaacaaagaaaacaatagaatgaaaagaacacctacagaatgggagaaaatgtttgcaaactacttatctgatctattatatacaaggaactcaaacatctcaacaggaaaaaaaaaaaatcccaatacaaaat

SEQ ID NO: 37591 - DNA, 417 bp, Homo sapiens
atcccagccaagtaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacgctgttcttgtagatggctgctctaaaaagacaaatgaatggggaaagacaatcattgaatacaaaacaaataagccatcacgcctgcccttccttgatattgcacctttggacat

SEQ ID NO: 37592 - DNA, 313 bp, Homo sapiens
  misc_feature 38: n = A,T,C or G
gagcagatacaccgaggagttaaaggatttgtccgagnaccttcaaggtaacccaattgcgaatgccgccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaact

SEQ ID NO: 37593 - DNA, 468 bp, Homo sapiens
catttggaagatgatgaagcttctacaatgtgaagtttactagaaggattccacaggttttataaatacaagtgtgttctgagattctaatggaaacttggagtcacaattggatttgaacattttttggaactttaatcttttggatacgtaatttgtaatctttactatttcatctaaatacgtttttttattttataaatttctcttttgtggaattttgaagtataaggaaaaccttgacaatggaaatataaaactccctcaaccctcataactcagagggcataacatgaataatcttagacaaaagttcttaaaatttaatctttacttagagaccattttaaaaaacaatctagaatacattaaagcttaaagatccaaaacaaactgagacatatctgaaaaagtactgggaaggtagatttttccatttaattactacaacataccataaatctatat

SEQ ID NO: 37594 - DNA, 118 bp, Homo sapiens
  misc_feature 8: n = A,T,C or G
tgcagtgnggtggctcacacctgtaatcccagcactttggaaggccaaggcgggtggatcacctgaggttaggagttccagaccagcctggccaacatggcgaaaccccatctctact

SEQ ID NO: 37595 - DNA, 285 bp, Homo sapiens
ggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatt

SEQ ID NO: 37596 - DNA, 464 bp, Homo sapiens
  misc_feature 20: n = A,T,C or G
gttcttgggttctcccgaancctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccgctgactccaacctgggcagcagagcaagactctgtctcaaaaggggaaaaaaaattgctgatgtgacccatgaagggaactcattttcctcgtaattttggactgccacacattggtacctttagttctctgaaggcccacgtttttatcattaagacctatttg

SEQ ID NO: 37597 - DNA, 232 bp, Homo sapiens
agtgtatttgtggtctgtgattaaggtctctaggactcagcatatcgcacagcagtgggctccaattatgtcctattttaatgccctgtcacggagcagggaagagaaacccccttctcttattggttgagtgtattgtgagagggtggaagctgggggtcctgtgtcctggattggttgggagctaggacattggagagagagagagagagagagagagagagagagagag

SEQ ID NO: 37598 - DNA, 443 bp, Homo sapiens
  misc_feature 83, 214: n = A,T,C or G
gctttccaacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcnttgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcctta

SEQ ID NO: 37599 - DNA, 471 bp, Homo sapiens
  misc_feature 11: n = A,T,C or G
ggaacgccagnatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgccttt

SEQ ID NO: 37600 - DNA, 159 bp, Homo sapiens; identical to SEQ ID NO: 33653

SEQ ID NO: 37601 - DNA, 173 bp, Homo sapiens
caggaattttatagttaatgcatgctgggcttaatacctaggcgatgagttgataggtgcagcagaccaccatggcacacgtttacctatgtaacaaacctgcacatctaccctggaacttaaaaaataaaattaaataaaaaaaaagatttttatttcatgctcaccagggc

SEQ ID NO: 37602 - DNA, 408 bp, Homo sapiens
  misc_feature 4, 19, 50, 288, 324, 331, 369: n = A,T,C or G
gtgnccgggaaaatcggcnttaggccggggctctttcccatcttgcaagnaggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggntgaaaagaaaaagaaggagaaggttctcgcaactgntacaaangcagttgggggggacaagaacggcgggacccggggggntaaacttcgcaaaatgcctagatattatcctactgaaga

SEQ ID NO: 37603 - DNA, 335 bp, Homo sapiens
ctacagttagggttgagttacttcctatcaagccgtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaataatatgtccttatcattgtataaaagctgttatgtgcaacagtgtggagattccttgtctgatttaataaaatacttaaacact

SEQ ID NO: 37604 - DNA, 448 bp, Homo sapiens
ggtttacactaagttctgtttttattaagattctttgggtcactttcttaatggaatttgcttcataattacctaaaagggaagatgcttctgtgtatgttcatttgtttcagggtaatattgtcatccatagctgctctccaatgcacaaaactgagtactcatggtatatagggaggcatatagggacattcatctctgttcctacatctttgtaaagactttggcacagagacaatacttagtaaatatgttttaattgaactgaataattgtttattatttctgccttatgatatcagaactacaataagctctgaatatacatccaaaaaaaagagaatatatttcagctaaaactgacttgacgaaatcagagaacacaggaagttctggatatttgcagatgaagtttaataaataggaataaaaggctcaataaaaaaga

SEQ ID NO: 37605 - DNA, 452 bp, Homo sapiens
  misc_feature 14, 15: n = A,T,C or G
aacatatgaaagtnnatcaatgcaatataccatattaatacaatgaagaggggaaaacccatgtgatcatctcaatagatatagaaaaaggatttaaccaaatctcacatccttttgtgataaaaactttcaacaaactagaaatagaagggaacttcctaaacctaataaaaggcatctatgaaaaacccacagctaacatcatacttaactgtgaaagactggaagctttccctgtaatatcagaaacatgatatggatgttttctctcaccacttctattcaacattttactagaaattttagccagggcaattaggtgagaaagagagttagaaatgagagaagtggaagagagaaagagagaatccagattagaagaaggaagttaaaactacctctattagtggatgacatgattttctaaaaaatcctaaagaaacacacacgtg

SEQ ID NO: 37606 - DNA, 471 bp, Homo sapiens
  misc_feature 15: n = A,T,C or G
agaaatactgcaagnaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaac

SEQ ID NO: 37607 - DNA, 366 bp, Homo sapiens
  misc_feature 16: n = A,T,C or G
aaagcagtggacaagnaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 37608 - DNA, 377 bp, Homo sapiens
  misc_feature 331, 337, 365: n = A,T,C or G
atggcagaggcccctgacagctgtgtctctctctctgctctaagcccccaaaccacaaagggcagaggctgggtgccagaggctctgtgacagccccactctgtttttgaactttctgcttcccttccactttgggaggccaaggcggggggatcactttgaggtcaggagttggagaccagcctggtcaacatggttaaaccccgcttctaccaaaaaaaaatacaaaaagccaggcgtggtggcacgcagcttgtaatctcagctgctctggaggctgaggcgggagaatcacttgaaccccgggaggcagaggttgcagtgagctganatcacnccacttgaactccagcctgggtgagaanagtgagctcctg

SEQ ID NO: 37609 - DNA, 325 bp, Homo sapiens
attgtaaaaaatcttttcatcaagaaaattcggtcctgaccagcacagtggttcatgtctgtaattccagcactttgggaggttgaggtgggcagattgcttgagcccaggagttcaagaccagcctggaaacatgacgaaacctcatctctacagaaagtagaaaaattacccaggcatggtgttgtgcacctctagtcagttccagctactagagaagctgaggttggaggattgcttgaggccaggagtttgaggctgtagtgagctgtgatcacactgctgtattacagcctgagcaacagagcaagactgtctcccacca

SEQ ID NO: 37610 - DNA, 217 bp, Homo sapiens; identical to SEQ ID NO: 29192

SEQ ID NO: 37611 - DNA, 469 bp, Homo sapiens
ggagtgagagggcagaggaaatactcaatctgtgccctcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaaagaagaggagacttcaaatgaaggagaaaacaatgaagaatcgaatgaagatgaagactctgaggctgagaataccacactttctgctacaacactgggctatggagaggacgccacgcctggcacagggtatac

SEQ ID NO: 37612 - DNA, 466 bp, Homo sapiens
  misc_feature 21, 33: n = A,T,C or G
gtataatttgaggtgaaattnagttataaagtnaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaataggccctttcataaaaaccaaactctagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagct

SEQ ID NO: 37613 - DNA, 163 bp, Homo sapiens
  misc_feature 15: n = A,T,C or G
ctagctggagcaatnagataagagaaagaaataaacacatcccaattggaatggaaaaagtcaagttatccttgtttttagatgatataatcttatatttgagaaaacataaagattccacaaaaaaaacattagatctgataaacaaattcagtcaagttga

SEQ ID NO: 37614 - DNA, 467 bp, Homo sapiens
cgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggatggggagcagctagaacaatgcagattcatccataatccctttctgctgttcaccaccaccca

SEQ ID NO: 37615 - DNA, 427 bp, Homo sapiens
gagatcagttttgcttgtgttattaatagtttataaaatactacattgcagtagttatataaaattttacaaaagttggaagcaggtagactacaggagtcattaaaagaatgttctccagtctatatagtttgtgtgattttttttccccagacttgtgacagacttgagatttttattaatagaaattgctccactgtctacaaaatcatatactctagatgctacttgttagttgactttctttgacaaataatttatttcttcttttgaaataaagctaattgattttgtaggttaatatctgttttcttcttcataagtgattatataaagataggctttctaaatggctaattattttatgcatatatgccagaagagaatcaatttgttttttgtcaacatctactaagcatctgtcctg

SEQ ID NO: 37616 - DNA, 472 bp, Homo sapiens
attgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacct

SEQ ID NO: 37617 - DNA, 470 bp, Homo sapiens
cgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggagggggggtctcattctacaaagagagaaggtggcccccctttcttgacctcctcctccttcaagctcaaacaccacctcccttattca

SEQ ID NO: 37618 - DNA, 467 bp, Homo sapiens
agagaaagttggaagttctaaaaatatcttttacttgttttttatgtattgagcttccatttaagatttaacttgaaaagtggattacaggtgtgagccactgtgctcgacccagatgagtatttttactgtgcactccatgtgatgccaggagaccactggtcttgatgacctctgatttttcatctctgatagaacacaagaacaaaccatattgagtactgagatgttagatattgccctttatacaaatgtctttcaaacatatgtcaggtttttaaaaaattctttttaaaaaatgctacctggaaaatagttataaaactgaaaaaagttatttatgtacgagaaagtaagaatggggaaaataggtaattgttgaagcttggagtggatacttagggatttattataccattttctatacttttgactgtgtttgaaaattttcataataaagatatata

SEQ ID NO: 37619 - DNA, 323 bp, Homo sapiens
attgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacgttttcaaaaaatccgctagacatgtcataagttttaactgtaatgcccaggaaaggatatcttaaaatattctaaacttgtgtaacaaaggaataattaactgtaacagtttttcaataaatcgagttgggtgtttccac

SEQ ID NO: 37620 - DNA, 421 bp, Homo sapiens
  misc_feature 39: n = A,T,C or G
gcagagaccctccttagggcaaaaatggattctatttcntattagtttggcagttgatttttgcacttaggagacattgtattccctaaggacccgctactgctttagaggaaaagaggtttttaatggaagaggaaataagtcaaaataaacgctatctgtttactgcagacacacttaactcctcttcctcttttagtcatgcacacctgctttctctgtttatactttaacctaatactactgttgagatgaccaattaaaatatctatttttaactttattatttgaatctagtgttctggtaaataaaatatagaatatttaacataatatggaggtagataatggtaaatacttgattttctatctgatatgtaactcaaaatagaagatcatatcggctaaatactacttattg

SEQ ID NO: 37621 - DNA, 251 bp, Homo sapiens
atttgtatatgtaaaatacacatacatttacatatgcatacatagctcactttttattggggagcacatcttcctgaaggtttttcaaagaataattattctacctgtaatgctgtagcagtatttgtaaaaagttcaaatgtggctgggtacagtggctcatgcctgtaattccagcattttgagaggccaaggaaggagggttaccttgagcccaggactttgagaccagtctaggaaacaccatccat

SEQ ID NO: 37622 - DNA, 219 bp, Homo sapiens
  misc_feature 5, 17, 71, 102, 136, 214, 218: n = A,T,C or G
acccngggaattcggcnttacggccgggaacttcggtttttataaacttagagctaaagcagacacagtangatttttttaatttgccagatattcttttantgagaattataaaagaccaaaaacattttttgcnaactgcctttttaaacaaatgatttgcttttaattacaaatactgtgcatgacgatgccttcctctgcaaaaccaatnaatnc

SEQ ID NO: 37623 - DNA, 306 bp, Homo sapiens
  misc_feature 49: n = A,T,C or G
ggtcctagcctttctattagctcttagtaagattacacatgctagcatncccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 37624 - DNA, 100 bp, Homo sapiens
  misc_feature 100: n = A,T,C or G
ggaatgcgctgtattcctgtcagcttaatgacgctaagcatagccccattccacatttctttttatttccacttgctaactaataaattacggaatagtn

SEQ ID NO: 37625 - DNA, 424 bp, Homo sapiens
taggagttcgaggctgcagtgagctatgattgtgctgctgtactccagcctgggcaacagagcaagaccctgtctctaaaaataaaaaatacataaatggctgggtgtggtggcttactcctgtaatcccagcactttgggaggttgaagcgggcagatcacctgaggtcaggagttcaagagcaagcctgaccaacatggcgaaaccccgtctctactaaaaaataataaaaacaaaagttaactgggcatgttggtgcatgcctgtaatcccagctacctgggaggctgaggcatgagaatcgcttgaaccaggaggtggagattatagtgagccgagatcgcgccaccgcactccagcctgggtgacagactccatctcaaaaaaataaacagagtgactctgtgcctgagaagggggtgc

SEQ ID NO: 37626 - DNA, 466 bp, Homo sapiens
  misc_feature 397: n = A,T,C or G
ggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggtttttttttttaaatgacaaactctaaaaatgtaccaatgggaaaaaacactttcctgaatgccattactcatgccctcaaagctttcatatntgtagcctactcctgtaaagggtttctcctgtttctagtttctagtttgcaaaggtatgccaacgaatc

SEQ ID NO: 37627 - DNA, 198 bp, Homo sapiens
agaaagaaggagaattggcatatgtttatatttagattctgctaagggctttaaaaatagataacactacgtataattatggcagtgatgaaagcaaatgctacttgagaactgtcctggcctacccttttgagtcagctgttcaaggaaagttggactcagtgttagaaaatttgagttttcaagttcagttggagg

SEQ ID NO: 37628 - DNA, 389 bp, Homo sapiens
ggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattc

SEQ ID NO: 37629 - DNA, 198 bp, Homo sapiens
agtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatg

SEQ ID NO: 37630 - DNA, 331 bp, Homo sapiens
  misc_feature 16, 28: n = A,T,C or G
atagaggaacaaattnagaagaaaagtntttgaatcccctcaaaactctcctgcgacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacaggattcaca

SEQ ID NO: 37631 - DNA, 316 bp, Homo sapiens
aacatttgaaatttttatattcttaactcatttaatcctcaccacaattcaatgatgtagggcactgttattgatctcatcttacaaatgaggagactgatgtattgtgagatgaagtagacactagactctcaatgttggcaaattatcaggatgcaaatatgtgatgcatgtgatgtgaatgcgtgggtgcttcttaaccgcggcatccttatgcagtgcacaaatgacataatcagttgcggcagcattgcacctgcaaaagaaaagccgaataatcttcattcttcaggtttcttagaaaatatggttaatt

SEQ ID NO: 37632 - DNA, 446 bp, Homo sapiens
ctcaccaggccctgcctccaacgttgggaattataattcaacatgagatttgggtggggacaaatatccaaactatatcaagggtattgcttgtccaagatcacatgttatgtcctgaaaacatctagttactgacagagttggttttgtaatatcggactttaaaggtcttcaaagaaataaaaatattctgacctatatggatatcttaatattctgaacctaattctttctgttttgaaggatataagatgcagctagttgtaattataagcaagaatgtctgggtaaaaatttggaaatttccacagatttctagtttgatgaagttgctatccatcatcctgaacttaaagttttgatttttccaagcaaggaacaattattacagttgtatgtaaaaattgaaagacttgaaaactctattatatataattgcacagaat

SEQ ID NO: 37633 - DNA, 460 bp, Homo sapiens
  misc_feature 40: n = A,T,C or G
gctaaacctagccccaaacccactccaccttactaccagnacaaccttagccaaaccatttacccaaataaagtataggcgatagaaattgaaacctggcgcaatagatatagtaccgcaagggaaagatgaaaaattataaccaagcataatatagcaaggactaactcctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactagg

SEQ ID NO: 37634 - DNA, 466 bp, Homo sapiens
  misc_feature 385: n = A,T,C or G
actgggaattttagaacttgcaaggtttcttatagatactacaaataatttacatacattttggaggtgaccacaggaaatttgaggttatcagagtttacatgtgaaccaaattatacctcccctctcctaagaagagctggcctccctctgtacaccctcttcctccctgcagaggcttgcagcgacctcggccaatccgggcactctgtaggccttttcctctttgctttgtcctcagtgtcctagccactcaccgtcacagcagtgttcttctgtggtcataaatcttttcttaacctcctcagccttttattctctaggtcaaataaccccagctccttttatcttttcttagtatggcctgtatcccaaccccttgatntttttattgctctcctctggactgcctccaattcttcgcctcagagttcaaaactggccacactattcttaaaagtctgag

SEQ ID NO: 37635 - DNA, 292 bp, Homo sapiens
tgaaaaagagtactggattttgttttttatccattgaggagttattgaccatcctttttccctactctgtccccagtaatcacaacagtagctacagaatttttctttgaaaggtttctgtcatataagagagctttaaaaaataataatttgctagaaaattttaaattatggttgggcgtggtggctcatgcctgtaatcccagtactttgggaggctgaggcaagaggattgcatgagctcaggagttcgaaaccagcctgggaaacatagtgagaccccgtctctatt

SEQ ID NO: 37636 - DNA, 161 bp, Homo sapiens
  misc_feature 139: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttgccg

SEQ ID NO: 37637 - DNA, 421 bp, Homo sapiens
aggacaagtaactgaaaatagtgcaaaccaaacaccagtatttaattttggacccaaagctcttctctgacttagaaccagttttcagaatataccttaagtaagggatggacaagctagatgtcttgcttccttaaccttggctcttcaattcttccccctttttcttcttaaagacagggcacctgtgaagttttccctactggccatagaggtgaaaaagtgtgattttaacactatgttcctgtatctcttggagtaacatcaaattaaactctgtcttccctagtaccattaaacagttcctagccactagactgagagtaacgtgttatttgggcaaatggatttgagattattattgagaatccttttggttgtaagtggttaaagttgcagattagttgctggctcatgactg

SEQ ID NO: 37638 - DNA, 413 bp, Homo sapiens
ggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttgtttattataataggtaaaaagaaaaaaaaaggttgtaattcatcacccatgtaaacatgctcatgaagttgaaagtaattaagatttgatacactgatatcaatttatttatgtaactaaatcactggtttataaacttgttaatgatcaacaatttttgttttgattaaaattagttttttg

SEQ ID NO: 37639 - DNA, 473 bp, Homo sapiens
  misc_feature 33: n = A,T,C or G
aagacaaggctatttgctcttgctacttctttnacattgtactggtgtgcacaccactttctccatcgaatatttaaccatcagtctcttcatttaaaaattcattgtggtagagataagttaccaaagaacaattaagaaaagaaatagaagataaccaaatactatggacttaaaattgaattaccccaaatattttatattttttaaacagaatacttttgttatactgcatgatcagaggaatattataatagatatagtatcatgtacatataatatatctaacattacatatatatgcatatatatacatatatatgctcaaataagtttgagaagaagtaagttaaacagttttcttttatgcagaagaacacctcagaagtgttgggactcctttgaggaaatgactttgacttttttggagttgacagaaatctccttgagaaactgtcctgataccttaaata

SEQ ID NO: 37640 - DNA, 125 bp, Homo sapiens
  misc_feature 52, 101: n = A,T,C or G
gaggcattgagacagccagcgcaggggcttctgctgagggggcaggcggagnttgaggaaaccgcagataagtttttttctctttgaaagatagagattantacaactacttaaaaaatatagtc

SEQ ID NO: 37641 - DNA, 400 bp, Homo sapiens
atagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaattaacacccatagtaggcctaaaagcagccaccaattaagaaagcgttcaagctcaacacccacta

SEQ ID NO: 37642 - DNA, 296 bp, Homo sapiens
cgtctgcgaaatctatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaac

SEQ ID NO: 37643 - DNA, 430 bp, Homo sapiens
gtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttccttttttttttttacttaaacat

SEQ ID NO: 37644 - DNA, 433 bp, Homo sapiens
atctcttatctgttgcctaaacagtgtttccaaaaattgaccaccttactatacagttcacttggatttcttaagaaatcagttaatttagctaactggcaaacagaactccaccacctcttctctggttctgaaacaatgtttccaaacgatggttgtcctttagcatgctgtcagagcacagtaggccccaatttttaaaagagataattcttttgtctttaattttgtcaattttagcccagttccacttagttcttgtgcctcatgttggatagttgctctagagaaatgtgatcccaggaatgctggtgatttgctgttttaaaatggtgctgtgctttaggtttctgttcaaatctaagatttcagaagagtcagtaactgcaaataatctaaaaggggaagagtgaagaatgcttctaacttccct

SEQ ID NO: 37645 - DNA, 466 bp, Homo sapiens
aagttactttggaaaataagtgagttttttaaactgtggttttgcctttctccatttattttaaatgttcgaagttctatgccttgagcatggtagtccaggcaaattttatttccagaataggagcacagatctgtgtgaaaacccataatctgttcagagatgatagcatgctaaatactctcaagtacttgagaggaataagaaagagatgagactttaaaaaggttaatacctgattcttaaaggaaagagtaaaaaattaaggacctttaagcagggagtgacataatcagatccatgttttagaaagataacagtggttgctaaaatgaaaagtggactggaggtcaggagggaatttactacagcaatccagcaatcaagaagcagagcacctcaactaatggcagtggtggtccgaggtggcaaagatgagtacatttgaagaatatttcatagacct

SEQ ID NO: 37646 - DNA, 385 bp, Homo sapiens
cacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaac

SEQ ID NO: 37647 - DNA, 463 bp, Homo sapiens
gggggattgtgggaaaagaggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaggattctatccgacgagtagtacaacacagcaatgtggtcatcaatcttattggacgagactgggaaaccaaaaactttgattttgaaggatgtttttgtgaaagatt

SEQ ID NO: 37648 - DNA, 429 bp, Homo sapiens
atttttctgttttcttacatttattttcttttttatatataaagtaagtctgccacctggaggtgaagaagttgaggggacaaacatacagtattctttttgggagaggataggggagtatgtgcctactaaagaaactttgtaagatgactgaagaactatcgatgctcattagatgtttaggaaggtgattttaatatgaaacctgtcagcttagtcacacatggtttttctcttgcaacatgtaactgcttgggcccaaacatggaattaattagtatatgtcatcagaatttaggttttgcctggcaaaaataatgaagagagtgaaggtgttgttgtggttggcttgctttagtctagaccgttgatgactgagtgaaggtgtttctagagtcacattatcaagatggacaggaaatctaggct

SEQ ID NO: 37649 - DNA, 330 bp, Homo sapiens
agaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatgt

SEQ ID NO: 37650 - DNA, 391 bp, Homo sapiens
  misc_feature 15: n = A,T,C or G
atccaaaagacaagnacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcaga

SEQ ID NO: 37651 - DNA, 205 bp, Homo sapiens
gttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgcg

SEQ ID NO: 37652 - DNA, 386 bp, Homo sapiens
  misc_feature 9: n = A,T,C or G
atatcaagnatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaatttt

SEQ ID NO: 37653 - DNA, 335 bp, Homo sapiens
  misc_feature 8: n = A,T,C or G
aggatggntagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacctg

SEQ ID NO: 37654 - DNA, 134 bp, Homo sapiens
ggatggggcctgggcctccttcctacaggggctcctctgtgggtgaggggccctctggaatggcatcccatgagcttgtggcctctatctgctaccatctgtgttttatctgagtaaagttaccttacttctgg

SEQ ID NO: 37655 - DNA, 182 bp, Homo sapiens
aagagaaaccccatctctactaaaaatgcaaattggccgggcatggtggtgcatgcctgttatcccagctactcgggaggctgaggcaggagaatcgcttgaacccgggaggtggaggttgtggtgagccaagatcacgccattgcactccagcctaggcaacaagagcaaactccgtcaca

SEQ ID NO: 37656 - DNA, 432 bp, Homo sapiens
  misc_feature 20, 23, 28, 359: n = A,T,C or G
ggcccgggggaaaaactggnagnacagnaagtacgggaaggcgatgtaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaatccaaaaattggataaaatagcactgaaaaaatgaggaaattattggnaaccaatttattttaaaagcccatcaatttaatttctggtggtgcagaagcgaagaaaagaatagagaagata

SEQ ID NO: 37657 - DNA, 444 bp, Homo sapiens
agctgaagactttccgggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactat

SEQ ID NO: 37658 - DNA, 178 bp, Homo sapiens
  misc_feature 178: n = A,T,C or G
ctagactggaattgtgatgatgatgatgatgatgatgatgatgatggttttacagggagatcgagggtttgatggacttccgggtctgccaggtgacaaaggtcacagggtaagatacatctattcctttttttccagggaatgttataaaatattttagaattgataacaatttgcn

SEQ ID NO: 37659 - DNA, 282 bp, Homo sapiens
  misc_feature 277: n = A,T,C or G
attacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggnggaac

SEQ ID NO: 37660 - DNA, 298 bp, Homo sapiens
  misc_feature 10: n = A,T,C or G
aacctcaaanctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccggggtggttaaacttcgcaaaatgcctagatattatcctactgaagatgtgcctcgaaagctgttgagccacgac

SEQ ID NO: 37661 - DNA, 415 bp, Homo sapiens
  misc_feature 22: n = A,T,C or G
ggtgatagctggttgtccaagnatagaatcttagttcaactttaaatttgcccacagaaccctctaaatccccttgtaaatttaactgttagtccaaagaggaacagctctttggacactaggaaaaaaccttgtagagagagtgaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactg

SEQ ID NO: 37662 - DNA, 417 bp, Homo sapiens
  misc_feature 22: n = A,T,C or G
aaggtgagtctgaaccaatagnaaagcaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttg

SEQ ID NO: 37663 - DNA, 472 bp, Homo sapiens
agcctctgtgctgccacccttggttgcccctctggttttggctgccaccctctgttgcttagatttctaccatagcctctatcacgagcctcctgcctccatgcttgttctccagtcacttctcactgtagcagctgactgaagcttgggaaacaaagtcagaatagagtctttcataggctgctttcttagctcagagtaaaagtacgggttcttacagtggctgacatgacagggccctacttgattggcctcccagccctcctctcctccttctacacagtcactccaagcacacaggcctgttcactgtttctccaccctgctcgcctgatcccgcccagagacctgtcacttgctgtttgttcattgtgcctggaatgccactccctcacggctgcccagctcactcccacactttcttcatgccttgacacagcaaatggcctcttcctactcctaaagctcttgc

SEQ ID NO: 37664 - DNA, 241 bp, Homo sapiens
ggaggccgaggtgggtagatcacctgaggtcaggagttctagaccagcctggccaacatggtgaaaccccgtctctactaaaaatacaaaaaattagccaggtgtggtattgtgtgcctgtaatcccagctacacaggaggctgaggcaggagaattgcttaaacccgggatgcagaggctgcagtgagccgagatcgtgccattgcacgcccgcctgggctacaagagcaaggctccgtc

SEQ ID NO: 37665 - DNA, 244 bp, Homo sapiens
  misc_feature 244: n = A,T,C or G
agaaaagctgaggcaggtggattgcttgaggtcgggatttccagaccagcctgggcaacatggtggggccccatttctactaaaagtacaaagattggccgggcatggtgctgcacccctgtagtcccagctgctcgggaggccgaggcacaagaatcacttgaactccagaggagaaggttgcagtgactcgagatcccgctactgcactccagcctgggtgaagaatgagactccatcgcgn

SEQ ID NO: 37666 - DNA, 445 bp, Homo sapiens
  misc_feature 42, 316, 444: n = A,T,C or G
atttgtaaaaaaacaaaaagcaaaaaattcccaaaacccagnataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggnatctaatcagattcctaatcatagcccgtaagaaggaatgttactttaatattggactttgctcatgtgctcgtgtccgcatttttttttttcttaaaatcatagccatatgggaaattttctatttng

SEQ ID NO: 37667 - DNA, 304 bp, Homo sapiens
gggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgt

SEQ ID NO: 37668 - DNA, 466 bp, Homo sapiens
ggttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattagggcagatatcattgcatcacatttatttatctttc

SEQ ID NO: 37669 - DNA, 370 bp, Homo sapiens
  misc_feature 38: n = A,T,C or G
attgttcattgagacagcaacatacgcactcctaaatngtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgct

SEQ ID NO: 37670 - DNA, 186 bp, Homo sapiens
acatatactctgtcacacacatatataaacataaacagataatgataaagcaaatgtaaaatatcaacagtttagaaaacaaggtgtaggttatgcagaaattctttgtactgtttttctcagtctcttattaagtgtgaaattatttcaaaattaaactattttgtaaaacttttttaaaaagat

SEQ ID NO: 37671 - DNA, 217 bp, Homo sapiens
  misc_feature 7, 215: n = A,T,C or G
agagatntgagaacacagctattttcagagcagtggaaaataaggttaaataagtagagtagaccccaaatgatagccctttgatagcaagcagagaagttcagattgggtgtggcagcattttagtgggtcctctgggttcttaggtggggagagagacacgaggaaaacagaaggccaggatgaaggttttggagtaatctacacacaaagtnag

SEQ ID NO: 37672 - DNA, 326 bp, Homo sapiens
tggctagccatatggagaaagctgaaactggatcccttccttacaccttatgcaaaaatcaattcaagatggattaaagacttaaatgtgagatctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaatagactaccatcagagtgaacaggcaacctactcatctgacaaagggctaatatccagaatctacaatgaactc

SEQ ID NO: 37673 - DNA, 467 bp, Homo sapiens
agaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtg

SEQ ID NO: 37674 - DNA, 314 bp, Homo sapiens
  misc_feature 32: n = A,T,C or G
gcttccttttcgatccgccatctgcggtgganccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaaga

SEQ ID NO: 37675 - DNA, 185 bp, Homo sapiens
cgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaact

SEQ ID NO: 37676 - DNA, 249 bp, Homo sapiens
aaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatg

SEQ ID NO: 37677 - DNA, 109 bp, Homo sapiens
cataattttttaaaagtgttttatcgagccacactttaggggaagttcatgattgaatggatctagtcattcagggaaatcctctctgtgtgaattaatacttcctttg

SEQ ID NO: 37678 - DNA, 206 bp, Homo sapiens
  misc_feature 25: n = A,T,C or G
agctttttttctatggagttggttntgattttgctgaaattataatcgctagttcctcgttgctgaggaaatcaaaccaatatgcaggaatcaaatgatggaacctttttgatataaagtcagcatgtaggcagcttgaggcaggagcatcacctggaggccaggagactgtgactagcctgggcaacacagtgagacctgtctct

SEQ ID NO: 37679 - DNA, 153 bp, Homo sapiens
agctgaaaactaatgtactgtacataaattccagaggactctgcttaaacaaagcagtatataataactttaatgcatatagatttagttttgtaacttagctttatttttcttttcctgggaatggaataactatctcacttccagatatcc

SEQ ID NO: 37680 - DNA, 119 bp, Homo sapiens
aggactctgcttaaacaaagcagtctataataactttaatgcatatagatttagttttgtaacttagctttatttttcttttcctgggaatggaataactatctcacttccagatatcc

SEQ ID NO: 37681 - DNA, 390 bp, Homo sapiens
  misc_feature 23, 214: n = A,T,C or G
ctcattgcagataatttttagcncagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgtngggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaagggcttccaggaagccacatccgcaca

SEQ ID NO: 37682 - DNA, 231 bp, Homo sapiens
  misc_feature 23: n = A,T,C or G
agccgaggcaggctgatcacctncggtcaggagtttgagactagcccagccaacatggtgaaaccctgtctctactaaaaaataaaaaattaaccgggcatggtggtgtgtgcttgtagtcccagctactgaagatgctgaggcaggagaatcactggaacacgggagatggaggttgcagtgagtggagatcaccattgcactccagcctgggcgacaagagcaaaactg

SEQ ID NO: 37683 - DNA, 296 bp, Homo sapiens
  misc_feature 19, 24: n = A,T,C or G
gaagggtccctaaaatcgngccanctagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcttgggtcccgcgccatcatctcttcgaatgacctcccttctattcctg

SEQ ID NO: 37684 - DNA, 235 bp, Homo sapiens
  misc_feature 81: n = A,T,C or G
gatgaaaggaaaaagaatgccacaatcagcagtctcctggaggagcagttccagcagggcaagcttcttgcgtgcatccgnttcaaggccgggacagtgtggccgagcagatggctatgtactagagggcaaagagttggagttctatcttaggaaaatcaaggcccgcaaaggcaaataaatccttgttttgtcttcacccatgtaataaaggtgtttattgttttgttcccac

SEQ ID NO: 37685 - DNA, 129 bp, Homo sapiens
cgatgaagaacgcagctagctgcgagaattaatgtgaattgcaggacacattgatcatcgacacttcgaacgcacttgcggccccgggttcctcccggggctacgcctgtctgagcgtcgcttgccgac

SEQ ID NO: 37686 - DNA, 354 bp, Homo sapiens
  misc_feature 33: n = A,T,C or G
caacatgggccgcgttcgcaccaaaaccgtgtngaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaacct

SEQ ID NO: 37687 - DNA, 276 bp, Homo sapiens
  misc_feature 4, 31, 276: n = A,T,C or G
atgngctgtgaccagttctcaccaccaacgncctcttctctctcccttctccttccttccttccttccttcctttctttctttttctttctttctctctttctttcttttctttctttctgtttctttcctttttatctttctctctttttctttctcttttccttttttgtttctttctttctttttctttctttctttttctttcttctttctttcttcgatgaagtctcactctgcactccagctagggggacagggcgagactccgtcttan

SEQ ID NO: 37688 - DNA, 320 bp, Homo sapiens
  misc_feature 23: n = A,T,C or G
gcaaggtcaccaagtctgcccanaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccatt

SEQ ID NO: 37689 - DNA, 380 bp, Homo sapiens
  misc_feature 35, 60: n = A,T,C or G
gtcagtcctttgctttaaaaaaattttgtggcttnattaaatttctaattgagcagattngattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatg

SEQ ID NO: 37690 - DNA, 396 bp, Homo sapiens
  misc_feature 32, 34: n = A,T,C or G
gacgagcctgaggcggagggagtaatggcagntnaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatct

SEQ ID NO: 37691 - DNA, 165 bp, Homo sapiens
atttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttg

SEQ ID NO: 37692 - DNA, 326 bp, Homo sapiens
  misc_feature 34, 36, 40: n = A,T,C or G
aagaaggcaaagtttacaacactaaatgattacntntagnaagatacaaagatctcaattaacaacctaaacttgcatctaaaggaactagaaaaacaagagcaaactaatcccaaagcttagcagaagaaaagaaataactaaaactagaacagaactaaacaaaattgaaacccaagaaaaagtacaaaggatcaatgaaatgaaaaattggttttttgaaaggttaaacaagattgatagactgctaactagactcaaaaaagagagaagatccaaataagcacaattagaaatgagaaaggtgacatcatcactgattccat

SEQ ID NO: 37693 - DNA, 139 bp, Homo sapiens
cacttcctctggggttcatctcttatctgatcctacttttgaatacttacatttttgtttttgttttttgagacaggacaggagattctcttgagcccaggagctcaagaccagcctgggcaacatggtgagactgtct

SEQ ID NO: 37694 - DNA, 250 bp, Homo sapiens
  misc_feature 11, 16, 89, 122, 128, 129: n = A,T,C or G
tggtgggccanctganagctccgatctccacgagaagactaatctaaaagctctgctttgtacttcctcaccctgctttcgtacaaggnagggggacgatgggaaatcatggacttgtaagntgtatnnaaacataaaaatgaacttggaacttctgggtttagtagagcctcagtgtcgctttaacttagtttactttttttttatttttaaagcagcaatggatggttttaaaggagtattatgattg

SEQ ID NO: 37695 - DNA, 126 bp, Homo sapiens
  misc_feature 126: n = A,T,C or G
cgatgaagaacgcagctagctgcgagaattaatgtgaattgcaggacacattgatcatcgacacttcgaacgcacctgcggccccgggttcctcccggggctacgcctgtctgagcgtcgcttacn

SEQ ID NO: 37696 - DNA, 138 bp, Homo sapiens
  misc_feature 24: n = A,T,C or G
cgatgaagaacgcagctagctgcnagaattaatgtgaattgcaggacacattgatcatcgacacttcgaacgcacttgcggccccgggttcctcccggggctacgcctgtctgagcgtcgcttgccgataaaaaagga

SEQ ID NO: 37697 - DNA, 103 bp, Homo sapiens
gagactccctgtcccggaccgcagcgttaaaaggatctgaacaaagtctgctcaaatctcctgctgtgaaccagcagaatttttgaacaggtttcttcacata

SEQ ID NO: 37698 - DNA, 299 bp, Homo sapiens
  misc_feature 25: n = A,T,C or G
gtgaggggatggaggaaggcgagtnttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacat

SEQ ID NO: 37699 - DNA, 345 bp, Homo sapiens
  misc_feature 7, 15, 33: n = A,T,C or G
ggtttanacaaagcngaaattggacctattctnactttccaaactggacaacttcataattctcagggtattagttagagtgtgcagaagaatcttgcctctgtagtgagagatcattatcagctctggactaaacgctacttttattctacctaacatattttaaaagcaggaacaaagaggatcaaataaattgcaggtaacttagctgtacccaaaaagacagctcaagaatatttatagtatacagatgaacccagcactcaacaaggcaaaatgtacaaattgcgaatataataaaatttacccaacatgatatgatggaagaaaattcgattcataatg

SEQ ID NO: 37700 - DNA, 321 bp, Homo sapiens
  misc_feature 25: n = A,T,C or G
aagctcctgcccctcctaaagctgnagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaaga

SEQ ID NO: 37701 - DNA, 366 bp, Homo sapiens
atcaatttaatttctggtggtgccgaagttagaaggtaaagcttgagaagatgagggtgtttaccgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctga

SEQ ID NO: 37702 - DNA, 382 bp, Homo sapiens
  misc_feature 24, 193, 307, 373, 382: n = A,T,C or G
gttttccttcaaagcatagagctnctggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagancaaaggaagtggcttaatgatcctgaagggatttcttctgatggtagcttttgtattatcaagtaagattctattttcagttgtgtgtaagcaagtttttttttagtgtagganaaatacttttccattgtttaactgcaaaacaagatgttaaggtatgcttcaaaaattttggaaatngtttatttn

SEQ ID NO: 37703 - DNA, 330 bp, Homo sapiens
agaatcctcacataagcccagttcatcaccatttcctcctttacctttcagtgcagttccttttcacattaggctgttggttcaaacttttgggagcacggactgtcagttctctgggaagtggtcagcgcatcctgcagggcttctcctcctctgtcttttggagaaccagggctcttctcaggggccctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatg

SEQ ID NO: 37704 - DNA, 235 bp, Homo sapiens
cgaatagtgactttcctactttataattactatcttttatcaacgtcagttttagcccattaacaaaggtggaagagaataatgagactcagcgttgacttcagttcttctattccaagaacaaaaattgactacatgatagaaatcatccaggtttttgttaaagtcaacctaagagaaaaatagcaagggcttccactacttccaaaagcacacattattataaaagggatga

SEQ ID NO: 37705 - DNA, 186 bp, Homo sapiens
  misc_feature 19, 184: n = A,T,C or G
gagggggcaggcggagctngaggcaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtngc

SEQ ID NO: 37706 - DNA, 343 bp, Homo sapiens
  misc_feature 16, 23, 323, 336: n = A,T,C or G
aagtgatccgccaggngaagggngacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacactttagcctctatccatggctacctgggcatcgnggagctttttggngtccttg

SEQ ID NO: 37707 - DNA, 351 bp, Homo sapiens
ctcattaattggcatttcccaatggatatgataaacaaaacttgaaaagagaaaaactttttccccctgtgagcagctctacttagtgtatgctggtgagagttggaactaatgtaatggctagcttagggatgtgtagggtactttagatttcagcttccattctgcccttttccccgtatgaacaagaagaaaatcaaaacatcattccaacaaggttaaactatatatacatccagataaagccaggtaaagattgatctagcttttaaatatatttgtataatgtttagattcaagagctcatgtgggaaaattagtatttttctagtactacagaccataaaattg

SEQ ID NO: 37708 - DNA, 144 bp, Homo sapiens
aaggtgcaaaaagttgatttaaaccctttgcagagttgaactctattatgaaaataaatttgctacggtatgaggaagaaataaaacttgtgtaatgttggtcataatactgctataaatataataaagggttatgtagaattg

SEQ ID NO: 37709 - DNA, 130 bp, Homo sapiens
  misc_feature 12, 17, 36, 45, 65, 83, 84, 85, 121, 130: n = A,T,C or G
cgccaagatgcnggcanttacaggcctgagccacangcccctggnctgatttacaatttttaatngagggttagggagtcatnnngaccaacaaagatgggaaaaggaatttgaggagaanacgaaagan

SEQ ID NO: 37710 - DNA, 414 bp, Homo sapiens
  misc_feature 21, 22: n = A,T,C or G
actattttaaattttagtttnnatgagacggggccttgctatgttgcagggtggtgttgaactcctggcctcaagcaatcctcttgcctcagcttgccaagatgctggcattacaggcctgagccactgcccctggtctgatttacaatttttaattgagggttagggagtcataataccaacaaagatggtaaaaggaatttgaggagaaaacgaaagaacaagggacaaataaaaactgcctgggttattcattattcatactgactccctaataaagtgattttcagtttgaatgtttttgcagacattgcctttcctcccttacagtgcttatttttttaaggtccaggttcacactagaaggccaaaacttccgcaaacatctgatgatgaaaagaaagatttttgaga

SEQ ID NO: 37711 - DNA, 257 bp, Homo sapiens
  misc_feature 22, 179: n = A,T,C or G
atacatgccctatacttggtangaaaatgtaccctctgcaccaaggcttgcctatgcattgtcggcttaataaggcctgccttgcttgtaagacattatattttcattgatgttttgaccttagaacatgagaaagcacatgaacatatagcaaaactgaatcttagggtcaggaaagntcttccagcatggcacatgtatacatatgtaactaacctgcacaatgtgcacatgtaccctaaaacttaaagtataat

SEQ ID NO: 37712 - DNA, 317 bp, Homo sapiens
  misc_feature 25: n = A,T,C or G
gaacatgcaagtggaagagagaatngttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactg

SEQ ID NO: 37713 - DNA, 184 bp, Homo sapiens
  misc_feature 131, 133: n = A,T,C or G
aagtacactttagaaagtctcttcaaaacaaacagtcctgtatttgaactctgttcatagtttttttttgaacagtttagacaaaactgctggaaattaaaccaatttcctgcattaagctgagacaagtntntttacagccctatacagtttcatagcttttcctcccccatttatgtgtatt

SEQ ID NO: 37714 - DNA, 210 bp, Homo sapiens
  misc_feature 25: n = A,T,C or G
gtcaccacacccggctaatttttgnatttttagtagaaacagggtttcaccatgttggccaggctggtctcgaactcccgacctcgggtgatcctcccatgtcagcctcccaaagttgctgggattatagatacaagccatcacacccagcccttaaatgttgtttttacttgctctaatgttcatgtttaactccattccttcactttt

SEQ ID NO: 37715 - DNA, 407 bp, Homo sapiens
  misc_feature 31: n = A,T,C or G
agcacccaaaaagcttatccaccatgatctntgggcttcatccctgggatgcaaggctggttcaacatacgcaaatcaccaaatgtaatccagcatataaacagaaccaaagacaaaaaccacatgattatctcaatagatgcagaaaaggcctttgacaaaattcaacaatgcttcatgctaaaaactctcaataaattaggtattgatgggatgtatctcaaaataatatgagctatctatgacaaacccacagccaatatcatactgaataggcaaaaactggaagcattccctttgaaaactggcataagacagggatgccctctctcaccactcctattcaacacagtgttggaagttctggccagggcaattaggcaggagaaggaaataaagggtattca

SEQ ID NO: 37716 - DNA, 285 bp, Homo sapiens
  misc_feature 24: n = A,T,C or G
tctgggctcaggtagttgggcagngctgtcctaagcaaagctgggtggacacagcctgaactgctaagcctaagtatgtgggatctcccccttcgagtatgcgactgaattttgtcctcagttttctgtaggatagactttacctgcccaggaaattggtggctaacggagatttgtcagagctctagtctgtcaagaatttggttatagttgctgttattgacacattttgtcttcaaataaagtgataaagataatctttttggcgctttattgtccaatcat

SEQ ID NO: 37717 - DNA, 177 bp, Homo sapiens
  misc_feature 7, 23, 31, 33, 52, 56, 68, 98, 109, 145: n = A,T,C or G
aacgcangctgaatcacctgagntggggagntngagaccagcctgaccaacntggngaaaccctgtcnctactaaaaatacaaagtatagccgggcgnggtggcacatngcctgaaatcccagctactcgggaggctgaagcagngagaatcacttgaacccgggaggtgcaggtta

SEQ ID NO: 37718 - DNA, 351 bp, Homo sapiens
  misc_feature 24, 251: n = A,T,C or G
ctgtaacagactaattggaattgncgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggngctcttaggaaggagtatagtaaatgcctcatttaataacatactcctttttgaaagttgccttttctctccacccttgagtagatccagtattttgatg

SEQ ID NO: 37719 - DNA, 348 bp, Homo sapiens
gcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 37720 - DNA, 359 bp, Homo sapiens
atatgataacttaatattaaattacattatttttccaataaatctaatatggtcattgattttaataaaatatttgattctaaaacgtgcatagaatatttttaataaataacttgattaatttttaaaaatgcagagggttggacttgccttatcagacattggaacttattacaaatatatggggaaaaatgtggtaactggtgaagttttagtttccattaagaaatactgcatatggccgggtgcggtggctcatgcctgtaatcccagcactttgggaggctgaggagggcggatcatctgaggttaggagttcgagaccagccctgccagcatggcgaaagcccctctctact

SEQ ID NO: 37721 - DNA, 477 bp, Homo sapiens
  misc_feature 7, 33, 35, 59: n = A,T,C or G
gggactnccctagtgttcacaacgacttatggntnagctggtttgttcctgaccctgcngggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatg

SEQ ID NO: 37722 - DNA, 166 bp, Homo sapiens
  misc_feature 92: n = A,T,C or G
cttccaacattttcttacgaaacattttcaaatacaaaattgagttttatttaaaacatttgcaaatatactacctagattctaccattgtngttttatatttgctttacttacaacttttaaaagatgctttttataccactgaacattttagcttacatttgac

SEQ ID NO: 37723 - DNA, 360 bp, Homo sapiens
  misc_feature 24, 179: n = A,T,C or G
catactttttaaagagaatgaatnaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgnggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgccctatgtac

SEQ ID NO: 37724 - DNA, 195 bp, Homo sapiens
  misc_feature 23: n = A,T,C or G
gaccaacatgaggaaacccttgnctctactagaaatacaaaaaattggctgggcatggtggtgggcacctgtgatcccagctgctcgggaggctgaggcaggagaattgcttgaacccaggaggcggaggttgcaagtgagctgatgttgcgccagtgcactccggcccgggtgacaggagcgagactccatctg

SEQ ID NO: 37725 - DNA, 352 bp, Homo sapiens
  misc_feature 25: n = A,T,C or G
tgcgcaggctgaagcgcaaaagaanaaagatgaggcagaggtccaagtaaaccgctagcttgttgcaccgtggaggccacaggagcagaaacatggaatgccagacgctggggatgctggtacaagttgtgggactgcatgctacctgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaat

SEQ ID NO: 37726 - DNA, 212 bp, Homo sapiens
  misc_feature 25, 178: n = A,T,C or G
tcatttaatgccattaatgcaaatntacttcctcttctttttgcatggttttgcccacctctgcaatagtgataatctgatgctgaagatcaaataaccaatataaagcatatttcttggccttgctccacaggacataggcaagccttgatcatagttcatacatataaatggtggngaaataaagaaataaaacacaatacttttacttg

SEQ ID NO: 37727 - DNA, 353 bp, Homo sapiens
  misc_feature 345: n = A,T,C or G
aggctattgtaagagatttctcctattttcttggaaattctctggaacagtagggtcatttgaatcatacccgttggtattgtcagatacattgtaaagtttcaactattgaacatatgtatggaatggaaattttaaaatagaaaattcgctatcttgccatttaagtatgataaaactatacccgattaaaacgttgactctattaggggttcgcctagtaagtaattctctggtcaagaatttgggaaattttgaactctgttaaccattaaaacaattacttctttaaggtaccggattttcatccatatttgaggagccttattaagttgttggggtggnctttttgt

SEQ ID NO: 37728 - DNA, 410 bp, Homo sapiens
cttgaacgcacatgtgctagaatatagtcatgttccacataacaacgttttggtcaagacaaacttctcagatagctgtggtgctgctcccgtaagattatagtggagctgaacgtaaccttgcagcatcacagcacaacacattactcactgctttgtgatgatgctagttcaaacaaacctactttgctgccagttgttttaaaagtactatatagtatgtacaattatgtccagtacataataataatgataataggacattgttagtggtttttgtatttactatactacatgttttatcattattttagagtgttctccttcgacttaaaaatgttaactgtaaaacaggcttaggcaggtccttcaggaggtgttctaggagaaggcattgttatcacaggaga

SEQ ID NO: 37729 - DNA, 407 bp, Homo sapiens
  misc_feature 34, 35, 37, 356, 362: n = A,T,C or G
gggaacatcctgacaatgtctggagacattttanntnaagctggagagggtctggggaagcgattctgctggcacttagtgggtaaaagatcctacaatgcacatgatgaagcaataactggcccaaaatgttaattttccaagattaaaaaaccctgttttgtattattccatttcgtcttcttcattggtttattatctgtaattcttgagttttttaattggttggtttcaggtttatggtatacttctttaacttatcacagtctatcttcaagccatatgttactgtttcatgtgtaatataaaagccttacaacagtatatgcccatttccccccttctggccttcatgngactgnaaaacattctacttctacatatgttatagactctacaatatatta

SEQ ID NO: 37730 - DNA, 320 bp, Homo sapiens
  misc_feature 318: n = A,T,C or G
tgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcnca

SEQ ID NO: 37731 - DNA, 135 bp, Homo sapiens
  misc_feature 25: n = A,T,C or G
cggcccctccatcgtccaccgcacntgcttctaggcggactatgacttagttgcgttacaccctttcttgacaaaacctaacttgcgcagaaaacaagatgagattggcatggctttatttgttttttttgtttt

SEQ ID NO: 37732 - DNA, 260 bp, Homo sapiens
  misc_feature 152, 155, 156: n = A,T,C or G
aacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagnggnntcctattctagagtccatatcaacaatagggtttacgacctcgatgttggatcaggacatcccgatggtgcagccgctattaaaggttcgtttgttcaacgatt

SEQ ID NO: 37733 - DNA, 402 bp, Homo sapiens
  misc_feature 8, 33, 59: n = A,T,C or G
gaaaggcnataggagaagctcaacttgagggcntgtagtaagttgtagaaggctcgagnggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactat

SEQ ID NO: 37734 - DNA, 319 bp, Homo sapiens
  misc_feature 26, 177, 308: n = A,T,C or G
gctacgccatggtttatggatacacntgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgctnctttcctgtatattctcttgtctggctgcacccctttttcccgcccccagattgataagtaatgaaagtgcactgcagtgagggtcaaaggagagtcaacatatgtgattgttccataataaacttctggngtgatactttc

SEQ ID NO: 37735 - DNA, 179 bp, Homo sapiens
  misc_feature 25: n = A,T,C or G
ataatgtggaaacattttaagttcnctctccggactgttttgctctctcaattcaggcaagttactgaagtacgttttttatctagaaaaaggtttgatgtagtctgtaaatggtccttgtaaagtacattgccatctcagaattaaaagatccactctcatttaaaaaaaaaaagggg

SEQ ID NO: 37736 - DNA, 109 bp, Homo sapiens
tgtacagaggaagctctcagataccagacttcagagacagcaggttgtaaagtgtttgttatcagatttaaaagaatgcctggctcttagttgattctctcctggatct

SEQ ID NO: 37737 - DNA, 353 bp, Homo sapiens
  misc_feature 18, 24: n = A,T,C or G
gacagaggcctccagctnggtctncctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggaga

SEQ ID NO: 37738 - DNA, 287 bp, Homo sapiens
gggggtgaagttaaactaataagcactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtac

SEQ ID NO: 37739 - DNA, 334 bp, Homo sapiens
agtgctgctcagttacgggtaaaacttggcactatctcccatccaagtactaacctggcccaaccctccttagcttccaagatcaggtgagattgggtgcattcagcatggtatggccttggacaaatttggctctatctacaaaatagcctgtctggagattacataatggcattaatatatccttaaaagaaaagtcaacagactcctcacctttatacccatttattgtttctgttttgttgttggaaaatgagttttagaattaatcgataggaaacccttctatgaatacctttataaagaaaggccaattatattttacttcatttat

SEQ ID NO: 37740 - DNA, 111 bp, Homo sapiens
ctccagaaggctgaggcgggagaatcacttgaacccgggaggcagaggttgcaagtgagccaagatggcagcattgcactccagactgggtgacagaacgagactccatcc

SEQ ID NO: 37741 - DNA, 164 bp, Homo sapiens
  misc_feature 17, 18, 45, 66, 77, 116, 154: n = A,T,C or G
accgggaaaacccggcnnttttggtccggggatccatccgtactnttacgtaccacttaacatccnttattgcattnactttgcgcagaataacccttgccgcctacctcacaagncaaggccacctgctgctctctttctactttaaaacatncttcctccat

SEQ ID NO: 37742 - DNA, 320 bp, Homo sapiens
gaggagtgaaggcggcaaaatggcggaccgtttctcccgcttcaacgaagaccgagactttcagggtaatcactttgatcagtatgaggaaggacacttggaaattgaacaagcgtcacttgacaagcctatagaatcggtaagataatcagtgcttaatttcgggtcttagctagttagttaggtagtgttccgtgtgacacttgatgtgagtgaagttaaacttattaataaccaatagtacagtttagagttgttttcttgcatgccatacagtaatcaattaaagcttgggatgtaatctaatatttaatatgttg

SEQ ID NO: 37743 - DNA, 300 bp, Homo sapiens
  misc_feature 34: n = A,T,C or G
caaatgcagtgcaggtggaagaaaacattaggtnggttaggtcagggaaaagcaatgttttcagggcttctgcaaaatgtgctaatgttgtgaggaaaatcaacaataagatcagggaagtagcactcgaaaccaatgtcttaaaaagtcatggacaaaaaaacaaaaacaaaacaaacgaaacaagatgagagaagacatggggattgttcttgtaaatgcagagtcaatcaatttgatttcttaacattaaaacactttgtgctttaaggatgtatcccagttaccccatcaaaaaac

SEQ ID NO: 37744 - DNA, 183 bp, Homo sapiens
gtgtcatatcattgataggacagatatgtgaggactgagaatttaattgacccctggatttgacactgtggaagtctttggtgacttccagaacggttgtggtagagtgccaggagtaaaatgcttacagatttcagtgtatggaagggaatgaaaagagaggatttataggtggccattaca

SEQ ID NO: 37745 - DNA, 302 bp, Homo sapiens
  misc_feature 26: n = A,T,C or G
gaatgagcgttgtgtcaaaaacaagnatcaagtatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatact

SEQ ID NO: 37746 - DNA, 367 bp, Homo sapiens
  misc_feature 8, 34, 35, 36: n = A,T,C or G
gaaaggcnaatcaagtaaggcattttcagggaannnggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatgtggggacat

SEQ ID NO: 37747 - DNA, 343 bp, Homo sapiens
acagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 37748 - DNA, 420 bp, Homo sapiens
aactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggac

SEQ ID NO: 37749 - DNA, 482 bp, Homo sapiens
  misc_feature 17, 43, 49: n = A,T,C or G
tatggccggggttgganaaatagatgttgtgtttgcatatgcncatgcnaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccct

SEQ ID NO: 37750 - DNA, 462 bp, Homo sapiens
  misc_feature 6, 32: n = A,T,C or G
ctacanaattggtggtattggtactgttcctnttggccgagtggggactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaaccgttgctggtgacagcaaaaaatgacccaccaatggaagcagctggcttcactgctcaggtgattatcctgaaccatccaggccaaataagcgccggctatgctcctgtattggattgccacacggctcacattgcatgcaagtttgctgagctgaaggaaaagattgatcgccgttctggtaaaaagctggaagatggccctaaattcttgaagtctggtgatgctgccattgttgatatggttcct

SEQ ID NO: 37751 - DNA, 203 bp, Homo sapiens
  misc_feature 203: n = A,T,C or G
atatacaattgttttaaccaagtgtgcacagtaatgatcacacttatagaaaatgtctgttttgttcataagtgaattaaaaaggtcaggaaagatatattccacattatgaacattttttttagaaaatgaaatgggcatgatgattagaaaaatgttgtaagtgctcattgtaggacagtcagataatatataaagatgcn

SEQ ID NO: 37752 - DNA, 350 bp, Homo sapiens
  misc_feature 7: n = A,T,C or G
ggagcgngcagtacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttg

SEQ ID NO: 37753 - DNA, 367 bp, Homo sapiens
aataatctctatttgttagcctggtaattctgatgccactggatttggataacaagaaacctagaaaattattattctgatataataggttttaaagtcttgtttttattaaagtttcttccttgtttagagtctcatctcattcacattagtttgatttgttttcaggtacagagtctaaaaatattcatcagttacaccagttgttcgcaaccttgattactcttgggaatttaaaaaataacaagctagctgggtgtggtggctcacaactgtaatcccagcactttgggaggccagggcaggaggatcacttgagcccaggagttcaagactagcctgggcaacccagaaagtcttcatctcc

SEQ ID NO: 37754 - DNA, 135 bp, Homo sapiens
  misc_feature 33: n = A,T,C or G
aggaagaagaggtggggaaaaggatgaatgtgnatgctgttacaatttttagtgacaataagaaaatgaatgaatttattaaacaatgatttctagtttctgtaggaagcaggggcaaagtcataggctgaggac

SEQ ID NO: 37755 - DNA, 369 bp, Homo sapiens
  misc_feature 33: n = A,T,C or G
gggagccgagccggactggtcaggatgatcacngacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccacttgaatagggcccagtataggggcttgcttttctactccct

SEQ ID NO: 37756 - DNA, 459 bp, Homo sapiens
  misc_feature 459: n = A,T,C or G
atacaacaagacatatcaacccaacaataagaaaacaaacaatccaattaaaaagtgagcaaaaggtgcaatcagacacctcaccaaataagatgtacagaagggaaacaatcatgtgaaaagttgatcaacataatttgtcgttagggaattgcaagttaaaacaaccacaagatatcactacacacctattagaatggccaaaatccaaaacactgacaatactcaatgctgatgaggatgtggagcaataggaactttcattcattgcttgtgggaatgcaaaatggtatagccacttgagaaaacagtgtggcagtttcttacaaagctaaatctaatccttctctatgatctagcaatatactcctaggtatttatccaactgatttgaaaacgaatgttcaaacaaaaacttgcacactattgtttatagcagctttattttaataattgccn

SEQ ID NO: 37757 - DNA, 468 bp, Homo sapiens
gggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaaccttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtgga

SEQ ID NO: 37758 - DNA, 332 bp, Homo sapiens
  misc_feature 34: n = A,T,C or G
attgagagaaagcatttaagtttgtttttcaganaattcctcagacgatgttaggctgggcgtagtggttcacacctgtaatcccagcactttgggaggccgaggtgggcagatcacttgaggtcaggagtttgagaccagcttggccaacatagtgaaaccccatctctactaaaaatacaaaaattagtgtgatgcatgcctgtaatcccagctactctggagactgaggcaggagactcacttgaacctgggagatggaggttgcagtgagccaagatcacgccactgcactccagcctgggtgacagagggagaccctgtctcaaatt

SEQ ID NO: 37759 - DNA, 292 bp, Homo sapiens
  misc_feature 34: n = A,T,C or G
atgaacagcctgcattaaagcgaaattctatcanattctcagaagggtcagtgactccccaaaaacgtaagaattgatccagcccaaagtcatcaaactgttaagaatcattgtctttttaggtcacattaaggtagttttttaatcactactttatgcctttctgtattttccaaactattttaaataaacatgcatagggcatgtgttgttgttgttgttgttgtttttaattaagtaaatgctgttttagaacctgaaaaaataaagtccatctttcttgaacctcctt

SEQ ID NO: 37760 - DNA, 280 bp, Homo sapiens
cagatcagtggtggcattagattctcataggagcacaaaccccactgtgaactgcgaatgcaagacctctaggttgcacacgccttatgagaatctaatgccttccatcacctccagatgggaatctaatgtcttccatcacctccagatggggccgtctagttgcaggaaaacaagttcagggatcccactgattctacattgtggtgaattgtataattatttcattatatgtaacaatgtaataataatagaaataaagtgcacaatacatgtaata

SEQ ID NO: 37761 - DNA, 102 bp, Homo sapiens
actgtacattccaaaaactctaaactttttaaagtattatagatacactaccaaacatatcaccttaaaattgtataaggctgaatgaacttcatacaaatg

SEQ ID NO: 37762 - DNA, 192 bp, Homo sapiens
  misc_feature 22: n = A,T,C or G
caccacaggactattcctagcntgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctac

SEQ ID NO: 37763 - DNA, 129 bp, Homo sapiens
agttctggaaaagccctggggacgagacaggtgctaaagttgaacgagctgatggatatgaaccaccagtccaagaatctgtttaaagttcagacttcaaatagtggcaaataaaaagtgctatttgcg

SEQ ID NO: 37764 - DNA, 163 bp, Homo sapiens
  misc_feature 14: n = A,T,C or G
gtacgactcttagncggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 37765 - DNA, 350 bp, Homo sapiens
gggggagggatgtgaagttatccagcctctgctaggcttcaagaaaaccgtcgtgcccgcttgagggtcaggacccacagggcattatcttgtctgtgattccgggttgctgtgacagccggtagagcctctgccctcccgaaactaagcgggggggcgtgggtcaaatcatagccaagtgacttgtttacattgtgagtgaaactgcacaaaggaacacaaaacaaaacttgcactttaacggtagttccggtgtcaacatggacacgaacaaaaccttacccaggtgtttatactgtgtgtgtgtgaggtcttttaaagttattgctttatttggttttttaatatac

SEQ ID NO: 37766 - DNA, 421 bp, Homo sapiens
  misc_feature 14, 19, 174, 190, 216, 282, 297, 299, 326, 391, 394: n = A,T,C or G
ggaaaactggaagnacagnaagtacgggaaggcgtttaaaagaatagagaagatagggaaacttagaagataaaaacatacttttagaagaaaaaagataaatttaaacctgaaaagtaggaagcagaagaaaaaaagacaagctaggaaacaaaaagctaagggcaaaatgtncaaacttagaagaaanttggaagatagaaacaagatagaaantgaaaatattgtcaagagtttcagatagaaaatgaaaaacaagctaagacaagtattggagaagtntagaagatagaaaantntaaagccaaaaattggataaaatagcnctgaaaaaatgaggaaattattggtaaccaatttattttaaaagcccatcaatttaatttctggnggngcagaaattagaagataaaaacatact

SEQ ID NO: 37767 - DNA, 174 bp, Homo sapiens
caggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggac

SEQ ID NO: 37768 - DNA, 290 bp, Homo sapiens
  misc_feature 17: n = A,T,C or G
gaagagataagcacagnaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatga

SEQ ID NO: 37769 - DNA, 299 bp, Homo sapiens
  misc_feature 25: n = A,T,C or G
aagaaagaatcttgggggccaggtncagtggctcacgcctgtaatcccagcaagttgggaggccgaggcgggtggattgcttgatgtcaggagtttgcaaccagcctgggcaacatggtgaaaccctgtttctaccaaaaatacaaaaattagccgagcgtgatggcacacgcctgtggtcccagctatttaggatgctgaggagggaggatcacttgaactcaggggatagaggttgcagtgagccgagactgcgccacttgcactgcaggcagggcaccagagtgacaccccatctc

SEQ ID NO: 37770 - DNA, 178 bp, Homo sapiens
  misc_feature 49, 100, 105: n = A,T,C or G
agagacgactgtactcctccacctcttgtggaaggacctgacatcagtnaggctcgcccgaagttatccggaaggcctaaccgtctccccgtgatgctgngcttnagtggtcacgctcctagtccgccttcaatgttccatcctgtacacctggctctgccttctagatagcagtagc

SEQ ID NO: 37771 - DNA, 485 bp, Homo sapiens
  misc_feature 44, 157: n = A,T,C or G
tatggccgggataagacaaaatacctgtaaagcacatacattanttataagcaatttattattgttcctggcacatagtgagtgctcaaaatatgttgccaattattggtcagtagtgctttgaaagtgaagatcccatggtagggacagagatcangatgacaattgcttgtttgctgagaacttcctttgaagttttgtcagtggaggctgctctagaatgctctaagagaaaaggaagctctctgtattattgaaccagccctcaaacaaatcacctcttttatatcactgtcatcaagaaaaaaagactgctaatgattactggtcagggtagaagatttgggcccaggcttgaggtctttggattctactccagaaatttccaagacaggaagaatcagaagagcctctaaaccaatacttctcagtcaggctgggagtgctatagtgggccagggatctggggccaatctgtctacttt

SEQ ID NO: 37772 - DNA, 195 bp, Homo sapiens
attgcatagtttcagatagctagaaaggagtttattaaatgttcccaatacaaagaaaatgataaatgtgtgtgatgatggagatactaattaccctgatctgattatcatacattatatgtattaaaacatcactatgtacctcatgaatatgtataattattatctgtcaattaaaaaataaattttaaaaga

SEQ ID NO: 37773 - DNA, 332 bp, Homo sapiens
attctctagtttcttagttttgttgtttttgaaatagtgaaacctgcattcgaaatctgatgactaatctatttttcacttatgaaggactaagtgattctcattaaaatttttaaggggttggtatagtcattaatttatcattattattattattatttttgagatggagtcttgctctgtcgcccaggctggggtgcaagtgatgcaatctcggcttactgcagcctctgcctcccaggagagtcgcttggacccgggaggtggaggttgcagtgagccaagattgtgccgccgcgctccggcctgggtgacagaatgaggctctgtct

SEQ ID NO: 37774 - DNA, 136 bp, Homo sapiens
aggaagaagagggtggggaaaaggatgaatgtggatgctgttacaatttttagtgacaataagaaaatgaatgaatttattaaacaatgatttctagtttctgtaggaagcaggggcaaagtcataggctgaggac

SEQ ID NO: 37775 - DNA, 418 bp, Homo sapiens
  misc_feature 35: n = A,T,C or G
ggaacatgttgaaaattaggtctgaattcaagtanaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgta

SEQ ID NO: 37776 - DNA, 433 bp, Homo sapiens
tatggccgggcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacat

SEQ ID NO: 37777 - DNA, 188 bp, Homo sapiens
aagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagttttc

SEQ ID NO: 37778 - DNA, 100 bp, Homo sapiens
  misc_feature 8, 96: n = A,T,C or G
gtcttcgntgcctatgtgcttcccaagctgtatgtgaagctacattactgtgtgagttgtgcaattcacagcaaagtagtcaggaatcgatctcgngaag

SEQ ID NO: 37779 - DNA, 211 bp, Homo sapiens
  misc_feature 3, 33: n = A,T,C or G
gcnaccacacctggctaatttttgtatttttantaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactct

SEQ ID NO: 37780 - DNA, 430 bp, Homo sapiens
  misc_feature 341: n = A,T,C or G
agaagactccagggatagtaccagcctcaaagctctgccaaatcttctcaatcaaacaatattatcagtactagatatttgtcagattgtcttgcagcctagatcttcttcatatgatttgcattctcaagcatattcattaggtacaaatttagaggaaagagaagaaattcccagtagttctaagtaagttcctggattcaattgcactgtccagacttaggtcacttgcctattcttgaaccagttgttatgctcagggtgctgggagcagactggttttctaggcctggctaaggaatattcagttctatgaaatactggtattgtctgagtatggnggctcgtgcctgtaatcccaacactttgggaggccgaggcgggtggatcactttgagcccagaagttcgagaccgggctgaacaacatg

SEQ ID NO: 37781 - DNA, 265 bp, Homo sapiens
gatcttgttactgtgatattttaaatatcccagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 37782 - DNA, 300 bp, Homo sapiens
caagctgactcctgaggaagaagagattttaaacaaaaaacgatctaaaaaaattcagaagaaatatgatgaaaggaaaaagaatgccaaaatcagcagtctcctggaggagcagttccagcagggcaggcttcttgcgtgcatcgcttcaaggccgggacagtgtggccgagcagatggctatgtgctagagggcaaggagttggagttctatcttaggaaaatcaaggcccgcaaaggcaaataaatccttgttttgtcttcacccatgtaataaaggtgcttattgttttgttccca

SEQ ID NO: 37783 - DNA, 164 bp, Homo sapiens
atttagaagctgacaggacaaagtcactttatttctccttttcctttaccttgaaattgttcctagccacagggctggccactcctcactgtccaaaaaactaccctgatgcagtatgcagtggcagatcagtttagtaaggaataacccaagtcaccgaatgc

SEQ ID NO: 37784 - DNA, 375 bp, Homo sapiens
  misc_feature 2, 105, 111, 124, 147, 160, 219, 278, 303, 358, 361: n = A,T,C or G
angggcctctcctaaggtagtaaatataatctgacttattctgaacccattctattttgaatctcccctttcctctcacaatacttgaacattttaatcttttgnaatatngtctttctttgtnataactattcatttttagctttngtctccagtgcgngatctcatatttttgcttttatttttagtataagaacatttataaaatcatatttttgncactgcaattgttttatttgttgtgtggcaaatgagaaatcctttatttattgtgctgngatctctctgtgtggaatgccttgngagagagatgcttattatgactattatcatttctgaccaagcttctattaatgtnatnttctaataatacac

SEQ ID NO: 37785 - DNA, 469 bp, Homo sapiens
ggattacaaaaagcaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattg

SEQ ID NO: 37786 - DNA, 405 bp, Homo sapiens
  misc_feature 7: n = A,T,C or G
atttcantgctttataaatcctgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattg

SEQ ID NO: 37787 - DNA, 225 bp, Homo sapiens
gaggcatctgaggcagccagcgcaggggcttctgctgagggggcaggcggagcttgaggaaaccgcagataagtttttttctctttgaaagacagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 37788 - DNA, 209 bp, Homo sapiens
atgcactttcatggagactgcaatacgttgctatgagcactttctttatccttggagtttaaccctttgcttcatctttctacagtatgacataatgatttgctatgttgtaaaatctttgtaaaaaatttctatataaaaatattttgaaaatcttaatttttcctgaattctgttccccaattatttaacaaggcttttgttacagg

SEQ ID NO: 37789 - DNA, 418 bp, Homo sapiens
aaaacagtagcagtctactaagttttctattattaaaattagtatagaaattatcaaaatactgaaaaaactgttttatgaaagcagtacctccatcactgtaacttatttcctttcttttagaatacatcttcaaaagagaccagaatttatttaaagatagtagtttgaattttaaatttccagtcaatttttcattatctcaaaattgagctaatgaagagttgatggagttaggagaacacaggtttccaactaatgccatcaaggcagcaggatcctcacatccatgaagaccaaaagaaagatgtaatggaagagagaactacggatctgtcttccatcctaatttaaccttcaggaaataccttctgcacaaaacacttcattaaataaaaaaaattacaaggacagtaag

SEQ ID NO: 37790 - DNA, 180 bp, Homo sapiens
attggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 37791 - DNA, 384 bp, Homo sapiens
  misc_feature 33: n = A,T,C or G
gaagttctaatgattctcaattctaatgacctnttaaaaagtgttgaagctgtgagcgtttttggctgtaacaatgactgagagttgctactgacatttaatacctgaaggacagagatgctgaacatcttgcaatacataggaatgacaaagaattgctcaaaatgctaagaacacacaaaatgccaagaattcctctgttaagatagactgcagtagggaagacaaggtaataacttggacccactatttaagatgctgtatgtaaagatgactatagtgattcatgaaaaataagtatttattaaagtttatgaacattactaaggaatttcttaaaatgcgaagttccatttctatagatactaattcatatagaagatg

SEQ ID NO: 37792 - DNA, 423 bp, Homo sapiens
  misc_feature 7, 34: n = A,T,C or G
atggtancgccctaggtgaattgagccttattantgtgggaacttatcatgccctcgttcaaccagaagctgacctttctcccttacaagtctgggcatttttctgtgttttgtttagttttgttttgcttttccttgtctctcatttttcatcaacccaaattgaaatggaaaaggcaatgcataggagcagttgaaacatggacaattctgtcatttgaccatcagaattccttctactgtcatttctcctcagtttgaatttatattagtaaaaacagatttgtgtgtgtaaaaatacacagaaacatactataacagttcaatccgtgtaaatcatttgagaagctgtcctaaatagcagaatgagtttatctgaggggaaattttgaaaccaaagtaattatcagatggccatttttt

SEQ ID NO: 37793 - DNA, 414 bp, Homo sapiens
  misc_feature 33, 212, 414: n = A,T,C or G
gggttccgagtgctgcgttcggctgtgctgttnagttgcgtagacagtggcctcgacaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagngtccgagtctaccactatttccagtggcgcagggcccagcgccaggccgcagaagaacaggagacctcaggaatcatgtagaactggggggctttttctcctgagcagagaggcccaaggcatgctgtggagagacttcacctgccaccatttccaggtcaacaggactagagcgttgatggttttcaaaccctgttggaan

SEQ ID NO: 37794 - DNA, 310 bp, Homo sapiens
aacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactgttgctacc

SEQ ID NO: 37795 - DNA, 149 bp, Homo sapiens
  misc_feature 9: n = A,T,C or G
aaccacagnagcagtcactccttcattcctcctctgtctctttgcacttttcttggtcttggccacagcctgagtgacgaatttcctactgaatgtaccaagttccaatttttaagggggggaaaggtttcaaatggggaaaaacacac

SEQ ID NO: 37796 - DNA, 109 bp, Homo sapiens
  misc_feature 2, 57, 98: n = A,T,C or G
gnaggccttgaggcagccagcgcaggggcttctgctgagggggcaggcggagcttgnggaaaccgcagaataagtttttttctctttgaaagataganattaatacaca

SEQ ID NO: 37797 - DNA, 398 bp, Homo sapiens
aggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgttttt

SEQ ID NO: 37798 - DNA, 341 bp, Homo sapiens
  misc_feature 113: n = A,T,C or G
ccaaagagtacggggcccaggaaaacacctttctacaaggtatagttcattagaaaccaggactgcttctgcattgttgatgcttaagtcacactcagtatttgacatggtantgtgtacacatacacattttgttaactttgacagtttattcatctagcaaaataaaggaatgtttgcttttaatgcaattcccacagttttggtccttttttctcacctcaagccagagaatgaatttttctacccacagttattctagtgtcgcatgtctttatttcaaaccaaattattttcatttaatctcttgctgacttcagtttctctgggccgtcaaatag

SEQ ID NO: 37799 - DNA, 350 bp, Homo sapiens
  misc_feature 350: n = A,T,C or G
cagccaaatttccgaatataaagtgacatgctaataggatatactgtggcatttctgtgtattacagcttgtatggtttgagttacttttccacacataattttttctcctccacacaagtcattaaatatgttttcctgagagatagtcaagctttgttgtataggaaagtttcgtttgtggaaataaatgagtttcactgtaagctaatgtaattctattacgtgaggaaatgttccttaaaaaataaagaatattatatactgttgttttcctgaatattttttaaaagacacattaactattgcctatttcatccttcatggacatcccacaatagattaccagcn

SEQ ID NO: 37800 - DNA, 277 bp, Homo sapiens
  misc_feature 250, 253, 258: n = A,T,C or G
ctgaaccatccaggcaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgataatgnagnacagnacaggttgcggtgggtgtc

SEQ ID NO: 37801 - DNA, 463 bp, Homo sapiens
  misc_feature 36: n = A,T,C or G
ggtaggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacat

SEQ ID NO: 37802 - DNA, 473 bp, Homo sapiens
gggggcgccccacaaccctgctcccccgacgtccaccgtgatccacatccgcagcgagacctccgtgcccgaccatgtcgtctggtccctgttcaacaccctcttcatgaacacctgctgcctgggcttcatagcattcgcctactccgtgaagtctagggacaggaagatggttggcgacgtgaccggggcccaggcctatgcctccaccgccaagtgcctgaacatctgggccctgattttgggcatcttcatgaccattctgctcgtcatcatcccagtgttggtcgtccaggcccagcgatagatcaggaggcatcatttgaggccaggagctctgcccgtgacctgtatcccacgtactctatcttccattcctcgccctgcccccagaggccaggagctctgcccttgacctgtattccacttactccaccttccattcctcgccctgtccccacagccgagtcctg

SEQ ID NO: 37803 - DNA, 121 bp, Homo sapiens
  misc_feature 6: n = A,T,C or G
gaaganaagtgttttcaacctcatacctggaggttacagtgagacatggattctagaagaggttgagaatatccctaggtctcacatcgtaagttcacttagctgaatgacaggatttggc

SEQ ID NO: 37804 - DNA, 183 bp, Homo sapiens
  misc_feature 5: n = A,T,C or G
aagangacttggaacgaaagtggcatttagcaagcgctcatcttacaccaagaaccacaatataagaaaactttcttgtggccctttcttttcatcagaacttaaaagagaaataaaattcaaaaagctcattaataactttgcataagtaaagctaatttaacttgcataagaattctatcc

SEQ ID NO: 37805 - DNA, 408 bp, Homo sapiens
  misc_feature 53, 67: n = A,T,C or G
gcagtacccagttagtttgtaccttttagggggcttttcaccttaactgcccntttgtgtaatttanagtttgacactgatgtgtttgttttaaaaaaaaatgcctagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctt

SEQ ID NO: 37806 - DNA, 153 bp, Homo sapiens
  misc_feature 36: n = A,T,C or G
tatggccgggcatgaatggtgggcacctgtaatccnagctactcgggaggctgaggcaggagaatcgcttgagccctgaaggtggaggttgcagtgagccgggatggcgccactgcattccagcctggatggcagagcaagaactccatctcc

SEQ ID NO: 37807 - DNA, 440 bp, Homo sapiens
gttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccacataccgcagggcttgcttctgtcaagtgtgactctatctcagtaattaaaataagtgctgatctac

SEQ ID NO: 37808 - DNA, 217 bp, Homo sapiens
  misc_feature 2, 15: n = A,T,C or G
cntattggccgggantgaaccggtgataggaagctcaaggcagtatttctcaccagtaacctacagagaagtcctttgaagaaaatgactgaagaaaatgctgggtgatgtttttaaaaaatcactacaaccatcagttactgatttcagctgacaataaatagcagtttactgctgtcattgtccatgcctacaaataatttattttgtatttttg

SEQ ID NO: 37809 - DNA, 287 bp, Homo sapiens
  misc_feature 17, 20: n = A,T,C or G
tatggccgggagaagangantgcacggaggagctctttgacttcttgcatgcgagggaccatttgcgtggcccacaaactctttaacaacttgaaataaatgtgtggacttaattcaccccagtcttcatcatctgggcatcagaatatttccttatggttttggatgtaccatttgtttcttatttgtgtaacctgtaagttcacatgaacctcatgggtttggcttaggctggtagcttctatgtaattcgcaatgattccatctaaataaaagttctatgatct

SEQ ID NO: 37810 - DNA, 477 bp, Homo sapiens
cttcataacaacaatatctctgtagttggatcaagtgacttctgcccacctggacacaacaccaaaaaggcttcttattcgggtgtgagtcttttcagcaacccggtccagtactgggagatacagccatccaccttcggatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaatatatatgtcaata

SEQ ID NO: 37811 - DNA, 396 bp, Homo sapiens
aatataacaaaatttcccaacatgtggaaaatgatgtcttttttcaaaaatgtcaatagcagatacatggtacagtaagttaggggaaaaaatgaggtttcatatcttctagtttcctaattaaaaggagcccattctgggttggaagaaagtgtcagtaagatcatttctcctatttgaaaatcatgcaaagcttgtcagagcgactcaggccaggagtgtagctgggcgtgtagctaaatgatatctccccacatctatataataagctgttacctgctttaaaaggaaaagctctcagcatgactctaatgttgcatttctggaatgcagcttgaaaagctcttctcagggttgaacagagcatgaaggtaatggttattatctactcacatt

SEQ ID NO: 37812 - DNA, 172 bp, Homo sapiens
  misc_feature 3, 10, 42, 59, 60, 65, 95, 98: n = A,T,C or G
aanctgtgtnccttgcccaatccttctaggctgatgtaaaanaaaatttccaaacaaannctgantacttttccctttttaagaccacttgtgantantactcaaaagtgcacagtttgcctgtatgaagtaatatggttttaaattttaaataaaatgtttctagaaaaca

SEQ ID NO: 37813 - DNA, 425 bp, Homo sapiens
  misc_feature 3, 21, 37, 38, 44: n = A,T,C or G
ctntggcccgggcccaagaanctggttcccttgagannccttcntgcattgtgcagctttaagtgaccctagtgtcagtgtcttagactagagaggttggggctggatcatgaagggtcttgtaagccatacttagtttagactttatgtgcagtgaataaatggagggagcacatggaggaaattgttctgcagaattttaaataaaaagagtgatatgatcagttttacatttgggacagataactgaaaatattatgaaaaaggtcctggagaaagggagaatgttggaggcaaagaatccagagaaaagctgagtagggtttacgctaaggttaattgcagggagaatgtagaagaaatatttaggcagtaaaatgcttaggaccagtctggacaacaaagcgagaccctgtctctactta

SEQ ID NO: 37814 - DNA, 480 bp, Homo sapiens
caaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgt

SEQ ID NO: 37815 - DNA, 247 bp, Homo sapiens
  misc_feature 126, 144, 179, 187, 198: n = A,T,C or G
gaatctgggaggcagaggttgcagtgagccaagtttgcgccactgtactctagcctgggcaacagagcaagactccgtctcaaaaaaaaaaaattatttcaagacaatattttttatagtattgtnggggcaattaaaagagtnggcatacaaaaaggcatcaagcctgctcgctggtncatggtanatgctcaatanatacaggttctcccttaaattacaaacaacttgccaaatagccgttctt

SEQ ID NO: 37816 - DNA, 430 bp, Homo sapiens
gctcttccggggacgttgtctgcaggcactcagaatggtccagcgtttgacatactgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctg

SEQ ID NO: 37817 - DNA, 322 bp, Homo sapiens
  misc_feature 318, 321: n = A,T,C or G
aaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgangtnc

SEQ ID NO: 37818 - DNA, 475 bp, Homo sapiens
  misc_feature 223: n = A,T,C or G
gaaaaaggccttgtttttcaggaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgntttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactgggtttgactatattgttagctgccacagtaagcaggtcat

SEQ ID NO: 37819 - DNA, 444 bp, Homo sapiens
ataattcctaattttagctctactacttacagtctctaaaaacgagtccattactaaacttctcctgacctgatatttcttacactgtcaaaagaaggaaaaaagttagtttagtttagtggttttcatacttttttgaccatgactcaaggtaaggaagatgatttgcatcacagtctaagtacctatatctacatattattttattggagacctgaatttctttttaaatattttttatgtattttattttattttttgagatggagtcttgctgtgttgcacaggctggagtgcaatggtgctatcttggctcactgcaaccatcattttctgaggcaggagaatggcgtgaacccgggaggtggagtgagctgagattgcgccactgcactccagcctgggcgacacagcgagacactgtctcaaaaacaaaaacaaaac

SEQ ID NO: 37820 - DNA, 481 bp, Homo sapiens
  misc_feature 11, 447: n = A,T,C or G
gtccttaagtnaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggngccaaaattcattttctaacaccatgtgttagga

SEQ ID NO: 37821 - DNA, 469 bp, Homo sapiens
  misc_feature 13, 17: n = A,T,C or G
gacaaccttagcnaacntttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcct

SEQ ID NO: 37822 - DNA, 481 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaaga

SEQ ID NO: 37823 - DNA, 248 bp, Homo sapiens
ctatgacaaaactgtgttctttcacatggactgtgagccatatgactgagttcataacagtgttgggggttacaacgttacgatggcctgtcacatgtacacatcaatcacaagccacattttggtcccaggaatgttaaaatgttgggtgtggcaggagaatcccttgaacccgggaggcggaggttgcagtgagctgagatcgcgccactgcactccagtctggtgatagagcaagactccatctc

SEQ ID NO: 37824 - DNA, 432 bp, Homo sapiens
  misc_feature 2: n = A,T,C or G
tncttatggcccgggcatttcctaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtccc

SEQ ID NO: 37825 - DNA, 413 bp, Homo sapiens
catttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgt

SEQ ID NO: 37826 - DNA, 131 bp, Homo sapiens
aactgagatgtgtttcaattatattccttttatggaaaaggactctgaaaaaccctaaagtattctagggagaaactgtcttccatttcagttttgaatcagtattgttacactcaaaccaccctcttttt

SEQ ID NO: 37827 - DNA, 482 bp, Homo sapiens
tacctggactcagcggtagcaacctcgccccttgcaacaaaggcagactgagcgccagagaggacgtttccaactcaaaaatacaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgacaattgcccgaatgccagaagac

SEQ ID NO: 37828 - DNA, 179 bp, Homo sapiens
  misc_feature 13: n = A,T,C or G
atagtatttcacnctacttgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 37829 - DNA, 105 bp, Homo sapiens
  misc_feature 33: n = A,T,C or G
gggccccgcgatgtcggaagaaacccgacagancaaattggccgcagcgaagaaaaagttgagagaatatcagcagaggaatagccctggtgttcctacaggagc

SEQ ID NO: 37830 - DNA, 344 bp, Homo sapiens
tatggccgggcaggttctgtgcatccttgcttccggtgcactgggctgatgccacccgagagctggggaggcatttgcggggcatctgctcctggaattaggatctccctgagttggaatcctggcattggcaagtactcagccttgtgatggtgggcaggtgacttccccttttttatccccatttttctcatctctcacagagggtctattaagagatgcgcagtggtccacgcggctggccggctccataagtatctccttctccggcctcttgacaggcccctgctgctttgactcagcaccatgcctgtgcttgaagttctgattaaacggttgttccc

SEQ ID NO: 37831 - DNA, 478 bp, Homo sapiens
  misc_feature 404: n = A,T,C or G
gggcgcggtggcgcgtgcctgtagtcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggaaaggaaggttttaaggggaanaaggtccagtccttagcccttgaaatacaaagctcttctgacactgaatttggatgcaccttgttttatataat

SEQ ID NO: 37832 - DNA, 305 bp, Homo sapiens
ggacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatggga

SEQ ID NO: 37833 - DNA, 483 bp, Homo sapiens
ggagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacattagattctataaattcttact

SEQ ID NO: 37834 - DNA, 491 bp, Homo sapiens
  misc_feature 27, 34: n = A,T,C or G
tatggccgggggggcattgaggcagcnagcgcangggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagccttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattagaataatttgaaggcgatcttttaaaaagagattaaaccgaaggtgattaaaag

SEQ ID NO: 37835 - DNA, 193 bp, Homo sapiens
ggagatttgagtacctaacacttaggactgttgcaagaattcaaggagataagttatataaaaggatagagttcaagttgggcatggtggcacacccctataatcccggctactcaggagaccaaggtgggaggactgcttgagctcaggagttcaagaccagcctgggcaatgtaatgagaccctgtctcac

SEQ ID NO: 37836 - DNA, 485 bp, Homo sapiens
attccgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaattt

SEQ ID NO: 37837 - DNA, 215 bp, Homo sapiens
  misc_feature 19: n = A,T,C or G
tatggccgggagaaaagtnagagttctgtagttattccatggaaaagtacaaaataattcatagaaactgtgcagaatgaaaaatattcactttcactttaaaatttgtttttgtttaaatttactaaactttaaccaagaaatctttacagccaagaatatgtttttagcatcttgatttattcagaagtctagtgatagagaaaagtgcaccc

SEQ ID NO: 37838 - DNA, 121 bp, Homo sapiens
tgcggtggctcacgcctgtaatcctagcactttgggaggccaaggtgggcagatcatttgaggtcgggagttcaagaccagcctgaccaacatggtgaaaccccgtctctactaaaaatac

SEQ ID NO: 37839 - DNA, 468 bp, Homo sapiens
atcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacac

SEQ ID NO: 37840 - DNA, 497 bp, Homo sapiens
  misc_feature 3, 7: n = A,T,C or G
aanatgncgcaggaatcaaggtgaaaaggaagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgc

SEQ ID NO: 37841 - DNA, 327 bp, Homo sapiens
  misc_feature 5, 6, 23: n = A,T,C or G
ggacnncgcttttcatctgtccngctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttt

SEQ ID NO: 37842 - DNA, 238 bp, Homo sapiens
atggccgggcattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcaagagcgagactccgtcccga

SEQ ID NO: 37843 - DNA, 176 bp, Homo sapiens
tgcaaaggaagaattctccagccctacgtcagtagagttgagcttaagaaaccctgctttaaaccaggctctagacttccaagggttcttacggtgtcctttctaaattgatcaacagaggccgggaggatgcgggagagagtgctggaaaagataaacttactttctaacagccg

SEQ ID NO: 37844 - DNA, 452 bp, Homo sapiens
  misc_feature 2, 8, 441: n = A,T,C or G
cncagccnaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggngtttacaagtg

SEQ ID NO: 37845 - DNA, 211 bp, Homo sapiens
caagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 37846 - DNA, 355 bp, Homo sapiens
  misc_feature 129, 310, 316, 347: n = A,T,C or G
attccaaatggtgactactcacctttaaggattaaacacagaactggagatgaaatcacgtaccagtgtagaaatggtttttatcctgcaacccggggaaatacagccaaatgcacaagtactggctgnatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcncacaanatggatgggtccgccagcagcaccatgcctnaggaaaat

SEQ ID NO: 37847 - DNA, 490 bp, Homo sapiens
aaaccgaaaccctcaattttggatatgaatgtataataaacgcacatgttcattctaaacattttcttttcaaatacttttacattcctttaggtttcctaaagaaatgtagattccttctgccacttagtttttgctatttttagcagtttcttaaagtctgcaaattcctttcactcagtttttgcacttagttcataatgacttcacatttgacattgattgtccacaaaaggggttatttttagtttcaaaaggtgaacgttatttgttttagaaattctcgcgtatatttcttagtctaaagataggttttctaacataaaaatgtgatagtgtagtctgtttgctgagcacttgtagtggaacaaactcagtgctaaattcttggtttttaataactaatttatttattacagtaactgctaaatatgcttcaaattataaactatttgccaaaattacagataataatataaccaaacaccat

SEQ ID NO: 37848 - DNA, 352 bp, Homo sapiens
catctcttctgatactaaattatcagattttaatctttgccaacctaatcagtggcaaaatggtatctagttggccaggcgtggcggcttaacgcctgtaatcccagcactttgggaggccaggtggatcacctgaggtcaggagttcgagaccagcctggccaacatggtgaaacactgtctctactaaaaatacaaaaattagctgggtgtggtggggggaccctgtaattccagctactctggagactgaggcaggagaattgcttgaacccggggaggtggaggttgcagtgagccgagatcgcaccattgcactccagcctgagcaacaagagcaaaactctgtttc

SEQ ID NO: 37849 - DNA, 500 bp, Homo sapiens
  misc_feature 130, 132: n = A,T,C or G
tgaaatgaaattgaaataaaatcgaaatgagatgaaatgatgagatgatgaaataaaatgatgaaatgatgagatgtgatgagatgaaatgatgacatgaaatgatgagatgagatgagatgacatgaantnatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgaaatgatgagatgaaatgaggtgaaatgaaattagatgaaatgtaatgagatgaaatgaaatgacataatgaaatgaaataatgaaatgagatgaaataaaataatgaaatgatgaaataatgaaatgaaaatgaaatggaaatgatgagataagaaatgatgagatgaaatgatgaaatgagatgagataaaatgagatgaaatgatgagatgagatgaaatatgaga

SEQ ID NO: 37850 - DNA, 470 bp, Homo sapiens
  misc_feature 12, 17, 18, 65: n = A,T,C or G
tatggccggggnaaagnntccttctttaatttgctgagtaaagctgggtatctctcaactcaagnatgaattaaagacttaaacataatacccgaaactataaaactactagcaagagagcataagggaaacacttcaggacattagtctgggcaaaaattgtatgtgtagcacatcaaaagcacaggcaacaaaaaaatagacaaagcagacgatatcaaactaaaaagcttctgcgcagcaaaagaaacaatcagagcaaagagacaacctgttgaatgcagaaactatctgcaaactattcatcttacaagggacttgtatatccggaatatacaaggaactcaattcagcagcaaaataataatgataatgtgattttaaaatgggcaaaggatctgaacagacatttctcaaaagaagaagtagaggccgggtgtggtggttcatgcctgtaatcccagcacgtt

SEQ ID NO: 37851 - DNA, 260 bp, Homo sapiens
  misc_feature 4: n = A,T,C or G
aagnatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattgg

SEQ ID NO: 37852 - DNA, 500 bp, Homo sapiens
  misc_feature 2, 11, 29, 30, 31, 49: n = A,T,C or G
antaaacctgnggccagggacacccggcnnnttatggcccgggagggtncagcccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatcctttttgtatgggaaagactatat

SEQ ID NO: 37853 - DNA, 497 bp, Homo sapiens
  misc_feature 3, 27, 31: n = A,T,C or G
canacaaaacaaccactttattattanttanttatttttttgagatggaatctttctcggtagcccaggctggaatacagtgagctttcattgcaccactgcactccagcctgggctacagagcaagaccctgtctaactaaatgaatgatgaattatttttttaaatcattatttcctctgcttcaaaaactaaacttttagtattaaaaatgtagaggcttgcttttatttcattctgaatgaaatcctttgtcagagggacccagttgccatgtgctattcagggaaagatggtcagttctagtgctgagatatagtctaagatgcaggacctggatgtttttctcagattctttgattctccagggggaatcagaagatgaaaatcaaaccttagccctgtacatttcagaagcaaggaaaggactagtgagaacaccagctctctccactgctctgatcctaggtgtagtcactccatacctgttaactgag

SEQ ID NO: 37854 - DNA, 123 bp, Homo sapiens
gagactttcctttgtgtggtaggacttggaggagaaatcccctggactttcactaaccctctgacatactccccacacccagttgatggctttccgtaataaaaagattgggatttccttttg

SEQ ID NO: 37855 - DNA, 255 bp, Homo sapiens
tatggccgggaggataggaaggtaggggtctcacttcgacctcaagttcatatgactttttctaactcacctttaccacacagcccctactgtggggcttataaagtgtcatggagatttgtgaagtcaatgtttcctttccttgtttatgtgctttattaattaggtccctctccaaaacttttgcatcatcctaaactgaaacactatgcccatgaagaagtcattaaataaaagactgataaatttgactcc

SEQ ID NO: 37856 - DNA, 461 bp, Homo sapiens
  misc_feature 3, 5: n = A,T,C or G
gtnangaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccc

SEQ ID NO: 37857 - DNA, 456 bp, Homo sapiens
  misc_feature 7: n = A,T,C or G
atagctngagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgt

SEQ ID NO: 37858 - DNA, 500 bp, Homo sapiens
  misc_feature 8, 16, 29, 50: n = A,T,C or G
taaactgngcccaggnacacccggccacntatggcccgggccagcagccntaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagc

SEQ ID NO: 37859 - DNA, 464 bp, Homo sapiens
  misc_feature 7: n = A,T,C or G
caaatantttttattacctgtctttttatttgaagacgtacatttgcctccaaagttcaacacaagttcaactgaccctatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacattttctg

SEQ ID NO: 37860 - DNA, 106 bp, Homo sapiens
  misc_feature 8, 9, 15, 16, 19, 20, 29, 35, 45, 58, 63, 69, 73, 89, 97: n = A,T,C or G
cggggganncaagannttnnagtgagccnaagtantcgcgcccancttgtaacttccnagccntgggantgancaaggaatcaaagganttcttgtncttccgggg

SEQ ID NO: 37861 - DNA, 217 bp, Homo sapiens
  misc_feature 7, 17, 115, 117, 127, 194, 195, 216: n = A,T,C or G
cttttancgatagcatnactgctgccgtcggctcaacagtactccttggctggggctccgggcccttcatccaccagctcctcattcccttttgtgccctgacacgcatgcctcncnaacacattgngcacttttcccaaacacaacttttttccttttttgaggccatttatttattatacaagtaacttgtnntaaaaaatctaggccgggcgng

SEQ ID NO: 37862 - DNA, 252 bp, Homo sapiens
  misc_feature 6, 241, 252: n = A,T,C or G
ctcccngagcccagctgcccagggtggggagaaacaccctgtgtcccatgggatagtagtcctttccgcttgcagttgtgcccaaagaatcttaaatacaaatgagatatccttaggtagttgatcatttatgtaatatgtgtcttcactggggaatactgacttcctaaaatctcaagatggaagatataccacatgtaaattattttagagcaattaaattgttttcaggattttccantggaaaaaaan

SEQ ID NO: 37863 - DNA, 185 bp, Homo sapiens
  misc_feature 14, 47: n = A,T,C or G
tccccctaatttangggattacctctgcaggataaattcttagaacnaatggtggtttgtggggagggtgacagggtggataggcacaggattgggagacttttcactgtatctccttttgtatttttttgaattttgtaccatatgtatcacctattcaaaaaaaataaaatatttttaaatat

SEQ ID NO: 37864 - DNA, 496 bp, Homo sapiens
  misc_feature 4, 18, 53, 207: n = A,T,C or G
gagnacccctaagcaagnattttgttagattcctatttcctttcaagtttggntcaactattatattaaagcctagttagacatggatgtggtttatattttcaatcgatgtactcttttactcaaataaagcacttgtgatattacagacattgtaatccaatgtacagggctatgagtaaagttataatgaactttgtaactacnagactgaactccagaaaatgtgagggaagggcatgaagcactcacgtttttatgtgaataatgaatacctactctaaaaatgtgtattgacattggacaaaagtatatattctaaactacaaatggtaggtggtgtagcatagtggttaaggacactaaaatgtaaaggttaggttgtacagtagagtgactaagggtatagactgaagctagacctcttgagattgacaaattggccatatgacatatgagaaaatgatttaaccctctctgtgccttagttacatta

SEQ ID NO: 37865 - DNA, 122 bp, Homo sapiens
  misc_feature 2: n = A,T,C or G
anacttttgtggcttttgtaaatggaattgcattattgatttggctctcagcttgaatgttgttggtgtatagaaacgctactgatttttgtacattgattttgtatcctgaaactttattg

SEQ ID NO: 37866 - DNA, 481 bp, Homo sapiens
  misc_feature 3: n = A,T,C or G
ggnctgccaggtgggcaaagggaagtaacagacacacgatgttgtcaaggatggttttgggactagaggcttagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgatt

SEQ ID NO: 37867 - DNA, 498 bp, Homo sapiens
  misc_feature 1, 10: n = A,T,C or G
nggccggganggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttg

SEQ ID NO: 37868 - DNA, 162 bp, Homo sapiens
  misc_feature 2, 5, 8, 162: n = A,T,C or G
cnaantcntagtcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcn

SEQ ID NO: 37869 - DNA, 257 bp, Homo sapiens
  misc_feature 14: n = A,T,C or G
cgcgggataatgcnccacaactgtgttctttcacatggactgtgagccatatgactgagttcataacagtgttgggggttacaacgttacgatggcctgtcacatgtacacatcaatcacaagccacattttggtcccaggaatgttaaaatgttgggtgtggcaggagaatcccttgaacccgggaggcggaggttgcagtgagctgagatcgcgccactgcactccagtctggtgatagagcaagactccatctc

SEQ ID NO: 37870 - DNA, 267 bp, Homo sapiens
  misc_feature 13: n = A,T,C or G
catcacctagtanatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattgg

SEQ ID NO: 37871 - DNA, 200 bp, Homo sapiens
  misc_feature 2, 3, 197, 199: n = A,T,C or G
cnncgattataaagttctggagtcagtggtgatggttgcacaccattgtgtgtgtaccaagggccactaaatcgcacactttaaagtggttaaggtgggtgcagtggctcgtgcctgtgatcccagtgctttgggaggctgaggtaggaggattgcttgagccccggaattgaagaccagccttggcaacaaagcanant

SEQ ID NO: 37872 - DNA, 466 bp, Homo sapiens
  misc_feature 12, 16: n = A,T,C or G
gtggccggggangccncgcaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 37873 - DNA, 478 bp, Homo sapiens
  misc_feature 7: n = A,T,C or G
ggttccnttcctgcttatctctcgcctaagtcttaaagattaagagcttgtgaacagaatattggcagaaatatggacaatgaaggcctttctgatgaggtctcagatggaaatgaggaatatcttattagaaactgaaggtaaggtcatccttgttataaagtggcaataaacttggctgaattatcctcatgacagaggacgttgtgggaaaaataattaaaaagcaatgaagcaatgcactgaccaggcatggtggctcatgcttataatcccagcactttgggaggctgaggcagaagaattgcttgagccaggagttcaagaccagcctgagcaatatagtgagactttgtctctacaaaaacaaacaatcaaatgatagatagatgatagatagatagactacatatatatggtatatatgtacacatgaatatatagacaaaaatattttattaatattttgcttagatac

SEQ ID NO: 37874 - DNA, 499 bp, Homo sapiens
  misc_feature 10, 26, 27, 31, 33, 35, 38, 56: n = A,T,C or G
attcaaacgngcccagggaccacccnntttntngnggnccgggggcgcccatagtntatagtaccgcaagggaaagatgaaaaattataaccaagcataatatagcaaggactaacccctataccctctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacaccca

SEQ ID NO: 37875 - DNA, 168 bp, Homo sapiens
  misc_feature 4, 6: n = A,T,C or G
agananaccaatgtgcaactttaatatttattgataggcacactaattctcttgctgatggtaattaatgaggtgcttatatcttattttgcggtagtttaacgagcttcgggctataggagagatccggtgcttgctgtaaatgctgagaatcaaagatgctggagg

SEQ ID NO: 37876 - DNA, 478 bp, Homo sapiens
  misc_feature 2: n = A,T,C or G
antgcactctctgtgctatctttcttttttataaactcggaattatttcaaaataagaagtttctaacaaaagagattcaggagagtcaaacccttgggtgtgaaaaagttttaggaagactttcctgaatttattttgcctatattttgtttctgatgaatgagcaagggggttatatgatatatttgtgtctaaatacatctaaaagagctctttcattcgcataaaataaacatgctgtatgataacaaagtttatgtcagagttgagatggctctttatggtacatatatgctgtgccttctaaaaaatgtcatattatattcagtgaaagatgatgtttcttaaaatgaatgaatgtctctgaggtggctaacattagtccttctatagccagattagcaatcttagagcctggtcaggcacagtggctcttgtttgtaatcccagtactttgggaggccaaggtgggaggat

SEQ ID NO: 37877 - DNA, 486 bp, Homo sapiens
  misc_feature 35: n = A,T,C or G
tatggccggggaattcccggaaagttgctctcagnaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatggga

SEQ ID NO: 37878 - DNA, 214 bp, Homo sapiens
  misc_feature 2, 6: n = A,T,C or G
anggcnggagtttgagaccagctgaccaacatggtgaaaccctgtgtctactaaaaataggaaaactatccaggcatggtggcgggcactgtagtcccagctactcaggaggctgaggcaggagagtcgcttgaatccgggaagcagaggctgcagtgagccgagatcgcaccattgcactccagcctgagcaacaagagtggaactctgtccc

SEQ ID NO: 37879 - DNA, 487 bp, Homo sapiens
  misc_feature 2: n = A,T,C or G
gnttcctccctttgcattttctggttttaatccccaattgttggggcacttttttcctgaccagtgggagcaggtttgctaactgagaatgctgctgtgtgctgtggcctggtgagaatgccatggacttctctcgctcagtccaacaccttaggagaggtgggtcaggaactgctttgtgcgtggggagagcggaggacagccctctgctcttttgaccactaaagcaaagtattgcaccctcagctgggcactggggctgggagtcctctctgtgtctccccactgaggctgagcaaagtgacaaacacaccactggtgtctgtataaagtagcggtgtgggaagtgcaccctgtcttcaaacagcgttccttaatgctagtttgcacctgtccatgaatgcagtggcagtgccaagataactttcttgaaggaatgcttttgcaattagacctcgtgtgcctgtcttcatgcaggaacccccag

SEQ ID NO: 37880 - DNA, 497 bp, Homo sapiens
  misc_feature 4, 13: n = A,T,C or G
aaangcccatgtngtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacaggt

SEQ ID NO: 37881 - DNA, 148 bp, Homo sapiens
  misc_feature 3: n = A,T,C or G
ganaaccttagtccaaaccatttacccaaataaagtataggcgatagaaattgaaacctggcgcaatagatatagtaccgcaagggaaagatgaaaaattataaccaagcataatatagcaaggactaaccccctataccttctgcat

SEQ ID NO: 37882 - DNA, 446 bp, Homo sapiens
atagttcggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatcttgggactacgttcttggctccagacctggaatccacaaaagccaatccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgc

SEQ ID NO: 37883 - DNA, 199 bp, Homo sapiens
  misc_feature 27: n = A,T,C or G
cagccctcggactttccagcctccagnaactgtaagcaataaattcctttttaaaattaattacccagtctcaggtatttggttatagcaacagaaaatggactaagacagttctccatttcattctccctggctccaattaagtaactgaataagacttttggtatctactgagatataaagctttataaacataact

SEQ ID NO: 37884 - DNA, 494 bp, Homo sapiens
  misc_feature 9, 20, 50, 58: n = A,T,C or G
cttatggcncggggaagttnccaaaaacataactgaggctgctgcagagnaccaaagnaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttag

SEQ ID NO: 37885 - DNA, 176 bp, Homo sapiens
  misc_feature 6, 7: n = A,T,C or G
cagganncaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgacc

SEQ ID NO: 37886 - DNA, 486 bp, Homo sapiens
  misc_feature 3, 77, 316, 362, 428, 458, 482: n = A,T,C or G
ggngacgctggcacaggcactgaacaggctggggccttttgacggccttcttggtttcagccaaggggctgcgctancagcccttgtgtgtgccctgggccaggcagacgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggnggccactttcattccagcagctgcaccccagcgtcaggcctacctnaagttcttggaccagtttgcagagtgaaagatcaagaaatgtctctgctcctacatccagctcctntaggggcagccttccgtcatccatgccctnccaggaccctccactcactgctgngagt

SEQ ID NO: 37887 - DNA, 466 bp, Homo sapiens
  misc_feature 8: n = A,T,C or G
ggaaaatntcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatg

SEQ ID NO: 37888 - DNA, 500 bp, Homo sapiens
  misc_feature 6, 15: n = A,T,C or G
tatggnccggggaanggccctgcagcacaaaaatgtccttaagggtcccttccagctcgtaggaagagaatcctaggattcactgaaaggctgcatttcctattgcttgttttttggcagaagggctccttgctggggacagcaggaagtatcttcaattctcatacacactttgcaagcgtacggagagtctccctgtgtagactgtcagcctatgtttagggaggtctgctcgccttccctgctctctggttctgtgggatgcaaatacattctattcagctcaaggcagccaaggctttctgaaacacgtgtatgaggtggcttctgaactagactctatgtgagacagaaaatgttcacccatgctgggtgtggttgcttctgcctgtaatcctacactttgggaggcagggggatcacttgaggccaggagctctagatcagcctggtcaacacagtgagactccctcatctctacaaaaaaattgaaaagttag

SEQ ID NO: 37889 - DNA, 480 bp, Homo sapiens
aagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttcca

SEQ ID NO: 37890 - DNA, 288 bp, Homo sapiens
  misc_feature 7: n = A,T,C or G
gaatganacagcattggctgttgaataacattggtgtaggctcaagtctggaataaatgtgatatagatgggacgatattggacaaatgcaatttatttcattattcagcaacaaggtattccaaatgtctctgctaatgaatacatgaaaacagattacatataatgtgcacactgtgagtcgcatttgcagaattatttttgccacctctagcactatctgaaaccaacactgaatagcaatggtacttgagcttctagttgcaagaaaaagcaactttaaaaatt

SEQ ID NO: 37891 - DNA, 481 bp, Homo sapiens
atgataacaagcttagtaaactaggaatagaaggaagcttccctaacctgatcaagattatctatgaaaagcttagagcaaacatcacttttactggtgaaatgttgaaagatcttttctgcaacctcggcctcctggattcaggcgattctggtgcctcagccttccaagtagctgggattgcaggcgtgcgccaccatgtccggctgattttttgtatttttagtagatacagggtttcaccgtgttggccgggctggtcttgagctcctgggctcaggcggtcctcccgccttggcctaaggaagttctggtgttgcaggcttgagccccatgcctggccatattttttaaacattgtaataggaaattctagaattgaaaaatatgataaccaaaagcaggaattcagcagattaaacacagctgaagagataactatatactgaaaggtcaaaggaaaatatctacagtgaaaccc

SEQ ID NO: 37892 - DNA, 121 bp, Homo sapiens
  misc_feature 7, 8, 14, 15, 17, 27: n = A,T,C or G
aagcctnncccagnntntggctccagnaatttttgccaggcttacagaacacccactgcctagaggccatcttaaaggaagcaggggctggatgcctttcatcccaactattctctgtggc

SEQ ID NO: 37893 - DNA, 445 bp, Homo sapiens
tatggccggggcttcctttccacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttaga

SEQ ID NO: 37894 - DNA, 251 bp, Homo sapiens
gttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccgt

SEQ ID NO: 37895 - DNA, 469 bp, Homo sapiens
tatggccgggggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcttgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttact

SEQ ID NO: 37896 - DNA, 131 bp, Homo sapiens
  misc_feature 8: n = A,T,C or G
ctgcttcntccgccaactaatatttcactttacatccaaacatcactttggcttcgaagccgccgcctgatactggcattttgtagatgtggtttgactatttctgtatgtctccatctattgatgaggac

SEQ ID NO: 37897 - DNA, 499 bp, Homo sapiens
ggcatgggattctccgttgtgattcccccggactccactgtctgaagaccaggtttcctatgaagagggtctgatgggaacctgttcccagtgatttgaaggtacccgttgctttttttcctgggagtttttaggatcctcttttcccttgattagaaattcaatgaggatgtatttaggtggaaaacttttttacctgccttactcacatgttctttttcctcttccatttctccagttctggaatggtctgtgattctctttatttcttctttccatcttctctgttctccctttctggaagtcatactagttgggattgcctggattgatttccaccgtcttttaagttttctctgatgtctttttttttatttttttgagacagagggaattccatctaaaaaaaaataaaaataaaatgggtacattttaaatagttatacaagtacctgctaagaacctccttactatctcgaactcctgagctcaagtgata

SEQ ID NO: 37898 - DNA, 489 bp, Homo sapiens
  misc_feature 4, 8: n = A,T,C or G
caanaaancccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggccccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaag

SEQ ID NO: 37899 - DNA, 463 bp, Homo sapiens
  misc_feature 8: n = A,T,C or G
catggcanccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctg

SEQ ID NO: 37900 - DNA, 489 bp, Homo sapiens
  misc_feature 4, 6, 28: n = A,T,C or G
gttngncaacagtataatttgacaaagnaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgggtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgta

SEQ ID NO: 37901 - DNA, 418 bp, Homo sapiens
aatggtactaaatttagaaaaataccttcactctgttttgttaagagtttagtatttgccagagaaagaaatatcaaaaagttttgtttgtttaagtgtaatgaaaaatcaagcttagcatttataagaaacttagagccaggagtgttggctgacgcctgtagtcccagcacttggggaggccgaggcgggcagatcatgaggtcaggatatcgagatcatcctggctagcgcggtgaagccccgtctatgctaaaaataaaaaaaattagccagataatggtggtgcacccctgtggtcccggctactcgggaggctgaggccggagtattgcttgaaccctggaggaggaggttgcagtgagccgggattgtgccacttgtactccagcctggaggatagagcgagactgcccca

SEQ ID NO: 37902 - DNA, 485 bp, Homo sapiens
  misc_feature 28, 39: n = A,T,C or G
atttggctaggcagtcaaaagacctagnattttattttnagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatacctggttgtgaatattaaaagtttttctcattgatattgctctacaagaaacctacttaatacattttttagcggacatgggtcaatttctgtttatcattaataagggggtct

SEQ ID NO: 37903 - DNA, 327 bp, Homo sapiens
attttagattttaagcaaaattttaaagacaaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcaccttgctctacctg

SEQ ID NO: 37904 - DNA, 447 bp, Homo sapiens
accgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcat

SEQ ID NO: 37905 - DNA, 490 bp, Homo sapiens
ggctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagatta

SEQ ID NO: 37906 - DNA, 292 bp, Homo sapiens
atatagccattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctcccgc

SEQ ID NO: 37907 - DNA, 121 bp, Homo sapiens
  misc_feature 3: n = A,T,C or G
agnagtaaagaacgcgacttccacaaacctggattttttatgtacaaccctgaccctgaccgtttgctatattcctttttctatgaaataatgtgaatgataataaaacagctttgacttg

SEQ ID NO: 37908 - DNA, 411 bp, Homo sapiens
ataggtaaaaatgggaagataataattgtaataatagttgctctcacttgtaagagtggttgctgtgtgcaagttggtattctttatgtgtatcctgtgcaccctcattccatctccatgagttctgtgacgtaggtactattattagctccattttgcattatgaggaaactgaagggagagaaaaataacttgcccaaggtcatattgctggcaagtggaagagccagacctggaagcctggggtatgtggggccacagccctgccttcagaaccaggacctgctgcctgttttgtttagagccttaacatattgtgctcctactttttgaacaatttagaaaataagtgttaagaaaaaaatttagaaggacaaagaagaaaaggttttctttcttttaggtaggaga

SEQ ID NO: 37909 - DNA, 211 bp, Homo sapiens
  misc_feature 43: n = A,T,C or G
gaggagctaaaagcgaaggccgcggggaaggggcccttggccncaggtggaattaagaaatctggcaaaaagtaagctgttccttgtgcctgaggagatggtgaccctttatttcatctgtatttaaaacctctctattccctgccataacatcttttgccacgtatagctggaattaagtgttgtcttggagctgttgtacattttaaga

SEQ ID NO: 37910 - DNA, 138 bp, Homo sapiens
  misc_feature 17, 20: n = A,T,C or G
cattacgcgaaaaattnatnataccttcctagacaaatgtctgatttttgtttaaatctgtccgttaggtggcctttccttatctgaggtgtagtggtctaacatttaggaagccttgctttgactttatcgggcagc

SEQ ID NO: 37911 - DNA, 201 bp, Homo sapiens
gatgtacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccggctggga

SEQ ID NO: 37912 - DNA, 367 bp, Homo sapiens
tatggccgggagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttc

SEQ ID NO: 37913 - DNA, 168 bp, Homo sapiens
cgactcttaatcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgaaaaag

SEQ ID NO: 37914 - DNA, 462 bp, Homo sapiens
gtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttat

SEQ ID NO: 37915 - DNA, 128 bp, Homo sapiens
  misc_feature 3: n = A,T,C or G
ganctcttagtcggtggatcactcggctcgtgcgtcgatgaagaacgcagctagctgcgagaattaatgtgaattgcaggacacattgatcatcgacacttcgaacgcacttgcggccccgggttcct

SEQ ID NO: 37916 - DNA, 470 bp, Homo sapiens
atcctatggaacagattctggggagttttcatcagttggagaggagttttataggaatcattctcagccaccgcctcttgagaccttagggctggatgcaagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacaga

SEQ ID NO: 37917 - DNA, 305 bp, Homo sapiens
  misc_feature 3: n = A,T,C or G
ggnagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttttggttggcccccaagccctttaccaggggaagggaaaaagggcccaggaacctt

SEQ ID NO: 37918 - DNA, 500 bp, Homo sapiens
  misc_feature 2, 10, 37, 165: n = A,T,C or G
cnactatggnccggggctctcggctttcggctcggangaaggccaaggtgcaacttccttcggtcgtcccgaatccgggttcatccgacaccagccgcctccaccatgccgccgaagttcgaccccaacgagatcaaagtcgtatacctgaggtgcaccggaggngaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagat

SEQ ID NO: 37919 - DNA, 460 bp, Homo sapiens
  misc_feature 7, 27: n = A,T,C or G
cacagantacaagttcccagcattacntagtgctttagatgaattctttgatataatggacagccgctgtactgtgttaaggaaacaagacagtggcgaagcaccgtttagttctaccaaggtgaaaaacaaaggcaagaaaaagaaaccaaaggattcaaagcctatgttagttgggtctggaacaacttcagtaactccaaataatgagatcatcacttcaagtgaagaccatagcaatcaaaattcagatactgcaggcccatttgcagtgcctgaccatcttcggcaagacgtagaagaatttgaagctctctatgaccaacacagtaatgaatatgttgtccgcaataagaagctatgggacatgaacccaaaacaaaaatgttcaactctatatgattacttctctcagttgttggaggaacatggtcccttggacatgagtcacaagatgttc

SEQ ID NO: 37920 - DNA, 229 bp, Homo sapiens
  misc_feature 4, 13, 28, 76, 107: n = A,T,C or G
gatnaaaaggganaagcatcaagcacgnagcaatgcagctcaaaacgcttagcctagccacacccccacgggaaanagcagtgattaacctttagcaataaacgaanagtttaactaagctattactaaccccagggttggtcaatttcgtgccagccacccgcggtcacacgattaacccaagtcaatagaagccggcgtaaagagtgttttagatcaccccctcccc

SEQ ID NO: 37921 - DNA, 269 bp, Homo sapiens
  misc_feature 13: n = A,T,C or G
tatggccgggganaccctttagaaataaaaatactgggatcaaactggcctgcaaaaccctagtcagttaattctttttttcctccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagcac

SEQ ID NO: 37922 - DNA, 140 bp, Homo sapiens
gctgacagttaggttttgctctcttttgtaacaggttacgtagaccagcagtgtttaaatctaaatacgttgtgagtctgttatctgtcctatcgcgttttttaaatgactttttattctttatcatagctaagtaaata

SEQ ID NO: 37923 - DNA, 486 bp, Homo sapiens
  misc_feature 129: n = A,T,C or G
cattcacaaaatatttatgatgtatttactctgcaccaggtcccatgccaagcactggggacacagttatggcaaagtagacaaagcatttgttcatttggagcttagagtccaggaggaatacattangataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcat

SEQ ID NO: 37924 - DNA, 473 bp, Homo sapiens
ggtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagacggagagctaaggtccaagtgaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatata

SEQ ID NO: 37925 - DNA, 427 bp, Homo sapiens
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatct

SEQ ID NO: 37926 - DNA, 311 bp, Homo sapiens
agggtggacccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgctttgatttttggaaacacatcaaaataaataatggcgtttgttt

SEQ ID NO: 37927 - DNA, 486 bp, Homo sapiens
  misc_feature 1, 2: n = A,T,C or G
nnttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtgggagtt

SEQ ID NO: 37928 - DNA, 497 bp, Homo sapiens
  misc_feature 3, 13, 426, 483: n = A,T,C or G
aancccggcttcnttggccggggggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggnaggtaagaaaggaaagaaggctgctgttggtgttaagaagcagaagaagcctctggnggggaaaaaaggca

SEQ ID NO: 37929 - DNA, 469 bp, Homo sapiens
tcttttctaaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaacctgtgtttttaaattgttataacttcacacctttttgaaatctgccctacaaaatttgtttggcttaaacgtcaaaagccgtgacaatttgttctttgatgtgattgtatttccaatttcttgttcatgtaagatttc

SEQ ID NO: 37930 - DNA, 500 bp, Homo sapiens
  misc_feature 4, 20: n = A,T,C or G
aaanttggctacaaccccgnacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgcttggtgacagcaaaaatgacccaccaatggaagcagctggcttcactgctcaggtgatt

SEQ ID NO: 37931 - DNA, 159 bp, Homo sapiens
  misc_feature 2, 20, 140: n = A,T,C or G
cnactcttagtcggtggatnactcggctcgtgcgtcgatgaagaacgcagctagctgcgagaattaatgtgaattgcaggacacattgatcatcgacacttcgaacgcacttgcggccccgggttcctcccggggctacncctgtctgagcatcgcttg

SEQ ID NO: 37932 - DNA, 397 bp, Homo sapiens
ggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcaggatg

SEQ ID NO: 37933 - DNA, 473 bp, Homo sapiens
tatggccggggcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacacc

SEQ ID NO: 37934 - DNA, 397 bp, Homo sapiens
ggaaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatg

SEQ ID NO: 37935 - DNA, 473 bp, Homo sapiens
gtgaatgaataatgtattttcagtgtaacaaatttattataaaagtgtagttcgactcttcttggtcttggagtttgagagtacagaattacagggaatgaagagaggtataagtagatattttaatggaaatgaagtataaattaataacttgacttacccctccataagttactgctaactggagatacccttgtatgcccaacctgtaaaggaaaaagttctatttctatatttataggacattcttctcagtcaaggaacagtaagaaatatgtaggtttcaatcagttgctctcaaccctgactgcattttagaatcatttggagagtttttaaaaatatccatgcctgaatcttgattcccattttcatgtaatttgagacaagacctggtcatcagtattttttttaaagttctccaggtaatttgaatgtgcaggaaggattcagaatcactggtttaatttgtt

SEQ ID NO: 37936 - DNA, 462 bp, Homo sapiens
  misc_feature 27: n = A,T,C or G
gtgtgatgggtttattgaacgactagnagcagtgtacactcataacaacaagaaattatgtcagtttataaaatcaaagagaggcttataggacaaaaaaagacattgtaaatgaggcaaaagtctctggaagaaacattttttaaggtcatctagcagaatatttcctcatccctagaggacccacttccttgtgcctcagctgcttctgatgtttcttctcacctaaaaaaataaaatacagtgtacagtaaccatctggtcaaaatgtaacataatacctaagattggaagcctgccattgttccttgttgctgttgttgaacagccgacacaggtattctggtgatgttactgtggtgcttagttgccctgaacacattattttctgacagtgtgaaggatacatcttattttttactgttaagtacttacgtgtgaataggtgtaagaacattattg

SEQ ID NO: 37937 - DNA, 126 bp, Homo sapiens
  misc_feature 9: n = A,T,C or G
catcagganggaatgcagtcagacctaagaaagaacttcctgactaagccatactggagtgggctttagaaggaagctgtgtctcttattcctgggccctggggaccccggcactggtggaatgcc

SEQ ID NO: 37938 - DNA, 324 bp, Homo sapiens
gtctttaaaagtcatagcgataaagtctcagctttttgagagagtgggtttcagacatactactatacaggaaatctgattgttgcattgaaacaggatttgttatcacatcacggttagacatacccaaaaggcaaaaactacagtggtcatgattgctttacataagattttggaggagaaactgttagctccatgaaagcaggaactgtgttcactcttgaatgcctgctacctgcacatggtgaatgttctataaaatggtataatttaaagaaatggaggtccttagagttccaagatcaccggtcaaattttcattca

SEQ ID NO: 37939 - DNA, 326 bp, Homo sapiens
gggggagacggaatcttgctctgtcgcccaggctggagtgcagtggcgtggtctcggctcgctgccacctctgcctcccaggttcaggcaattcttctgtctcagcctcctgagtagctgggactaaaggcgcacaccaccacatccagctgatttttgtatttttagtagagacggagtttcgccgtgttggccgggatggtcttgatctcctgacctcgtgatctgcccgctgtggtcccagcactttgggaggccaagactggaggatcacttcagcccaggaatttcagaccagcctgggcagagagaccctgtctagctct

SEQ ID NO: 37940 - DNA, 199 bp, Homo sapiens
  misc_feature 46: n = A,T,C or G
tttgtggttagctccttcttgccaaccaaccatgagctcccagatncgtcagaattattccaccgacgtggaggcagccgtcaacaggccctgggtcaatttgtacctgcaggcctcctacacctacctctctctgggcttctatttcgaccgcgatgatgtggctctggaaggcgtgagccacttcttccgcgaactg

SEQ ID NO: 37941 - DNA, 151 bp, Homo sapiens
gaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 37942 - DNA, 466 bp, Homo sapiens
  misc_feature 344: n = A,T,C or G
ggaagctgcctggcgctagaaccggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcntcgatcaagcagtagctcttcttatggctccagaaggaaacgaagtcgaagtcgttcaaggggtcgagggaaatcctatagagttcagaggtctaggtcaaaagcagaacaagaaggtccag

SEQ ID NO: 37943 - DNA, 476 bp, Homo sapiens
gactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttg

SEQ ID NO: 37944 - DNA, 463 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaac

SEQ ID NO: 37945 - DNA, 312 bp, Homo sapiens
  misc_feature 310, 311: n = A,T,C or G
atgtcaatagtatctcagattgaccatttctgttacttgtcatttctactttcagaaactaaatgactttcaaatttgggtatagacaataaagaactggagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccannt

SEQ ID NO: 37946 - DNA, 263 bp, Homo sapiens
  misc_feature 22, 24, 179, 184, 261: n = A,T,C or G
aggagaagaagaaggaggaaancngcggggccccaaacccttaagaaaaagcgaaggaatttcgcagagctgaagatcaagcgcctgagaaagaagtttgcccaaaagatgcttcgaaaggcaaggaggaggcttatctatgaaaaagcaaagcactatcacaaggaatataggcagangggcnggaactgaaattcgaatggcgaggatggcaagaaaagctggcaacttctatgtacctgcagaacccaaattggcgtntg

SEQ ID NO: 37947 - DNA, 257 bp, Homo sapiens
atctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtt

SEQ ID NO: 37948 - DNA, 270 bp, Homo sapiens
  misc_feature 20: n = A,T,C or G
tatggccgggagctcaaatnacttgggcatttactgaatatcaactacatgtataaactgaaaaaacagaattgactttaatttagttcattcttataaacaaattactctgtgatgtggatttttggaatatatgtagtttcagatacagttctgatttgtataaaaccatgaaaagcagcactttggaagtccgaggcgggcggatcacaaggtcaggagttcaagaccagcctggccaacataatgaaaccccatctctacttaaga

SEQ ID NO: 37949 - DNA, 316 bp, Homo sapiens
tatggccggggaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaagtaaatattgtgttgtgcagcattaaaaaaaatcaaaataaaaattaaatgtgagc

SEQ ID NO: 37950 - DNA, 482 bp, Homo sapiens
gctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtaggaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagta

SEQ ID NO: 37951 - DNA, 463 bp, Homo sapiens
ggaactctgctacagaccaataaaacttcggtcaagttgcgagcaaaagggattatttggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagc

SEQ ID NO: 37952 - DNA, 497 bp, Homo sapiens
  misc_feature 10, 17, 24, 29, 31, 33, 35, 40, 48, 49, 64, 65, 100, 307,428: n = A,T,C or G
attgcacaanaaggcgngggcaantcgangnantntagcncactgccnntcctaaagctgaagnnaaagcgaaggctttaaaggccaagaaggcagtgtngaaaggtgtccacagccacaaaaagaagaagatccgcacgtcacccaccttccggcggcccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgntcattgtggatgttaaagccaacaagcaccagattaaacaggctgtgaagaagctgtatgacattgatgtggccaaggtcaacaccctgattcggcctgatggagagaagaaggcatatgntcgactggctcctgattacgatgctttggatgttgccaacaaaattgggatcatctaaactgagtccag

SEQ ID NO: 37953 - DNA, 246 bp, Homo sapiens
aagttgagtattagagagcttgtctttcaaggcaggttcctggggcttcagggctaggagggaggagactgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagg

SEQ ID NO: 37954 - DNA, 396 bp, Homo sapiens
gatgaaaattccttggagatttctcatgctaatgctaggtttagcattatataaaaacaattgagtaggatcttctgcttctgttattttccctgcattatctcagatctttttagtaactttttaattattgtttttgtctttatataaagagggtcttgctgtgttgcccaggctggtcttcgaactcctgaggtcaagtgatccgcctgcctcgacctcccaaagtgctgggattacaggcacgagcaactgcaccaggccctttttagtactttggaccatgaaataattcttttttaacagcaaaaagagataaattacactcagtcagatgcattcataatgctttagactactgaaagaaatatccatgggggaaaaattagaagaaac

SEQ ID NO: 37955 - DNA, 115 bp, Homo sapiens
  misc_feature 58: n = A,T,C or G
atgagccctacaaacaactaacctgccactaatagttatgtcatccctcttattaatnatcatcctagccctaagtctggcctatgagtgactacaaaaaggattagactgaacc

SEQ ID NO: 37956 - DNA, 167 bp, Homo sapiens
atattaagattgagtatccctaatccgaaatccagaatgcttcaaaatttgaaattttttgagcagtagtaacataatgttcaaaggaaatgctcattatatcatttcagatttcagatttttggattagggatacttaactggtaagtatataatgcaaatattcc

SEQ ID NO: 37957 - DNA, 407 bp, Homo sapiens
  misc_feature 406: n = A,T,C or G
cttccatgtgttatacttgagtgaaaatttacgggctacataaatatggctgttgtttggaaagaaaatgttgtgacattagtatgcgcacaagacaatgggaagtacgaactaggattcctgtaaatacgagaaaggaaaagaatgcttttactatgttagaagacttaaaatcacatgaagtgattccagtctttctgttgttattccgatgttttagctattttagattttggggtttggcttttttttgtttcattgcctttctacataattggataaccttgttagtatctgcagaatgccctgattaggaaatgtgttaaccctatgtgtcaatttggtataatttcatatttgttttcatattgttttatgtggagtcttccaataaatgtatattgtnt

SEQ ID NO: 37958 - DNA, 464 bp, Homo sapiens
gggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccgtgt

SEQ ID NO: 37959 - DNA, 470 bp, Homo sapiens
  misc_feature 215, 357, 360, 423: n = A,T,C or G
atttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagngctagagtaggtgcagaagtggtaggtcagctacaaatttgaggacaagataccaaggcaaaccctagattggggtagagggaaaagggttcaacaaaggctgaactggattcttaaccaagaaacaaataatagcaatggnggngcaccactgtaccccaggttctagtcatgtgttttttaggacgatttctgtctccacgatggnggaaacagtggggaactactgctggaaaaagccctaatagcagaaat

SEQ ID NO: 37960 - DNA, 380 bp, Homo sapiens
gagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatg

SEQ ID NO: 37961 - DNA, 313 bp, Homo sapiens
acataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccataagttttgtttaatttgcttccttttaaataaacccattggtgaaagtc

SEQ ID NO: 37962 - DNA, 150 bp, Homo sapiens
caccatgaccctcttccacgctgacctgtgctccctctccaatcatctttcctgttccagagaggtggggctgaggtgtctccatctctgtctcaacttcatggtgcactgagctgtaacttcttccttccctattaaaattagaacctg

SEQ ID NO: 37963 - DNA, 255 bp, Homo sapiens
ggcggcgtcgccaggaagagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcat

SEQ ID NO: 37964 - DNA, 436 bp, Homo sapiens
gtatcccaacataacctctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattcc

SEQ ID NO: 37965 - DNA, 275 bp, Homo sapiens
  misc_feature 24: n = A,T,C or G
caccaaaatgcagattttcgtganaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaaga

SEQ ID NO: 37966 - DNA, 400 bp, Homo sapiens
attaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacgaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaac

SEQ ID NO: 37967 - DNA, 375 bp, Homo sapiens
  misc_feature 8, 33: n = A,T,C or G
attctacngaacaaacaaaataattagctacantttatagaggttaccttggttgtttgtcttaatgtttttgctcaaaaaatgtcactcggggctgggtgctgtggctcactcctgtaatcttagcattttgggagactgaggcacaaggatcgcttgggcccaggagttcgagaccagcctgggcaacatggcaaaaccctgtctctacaaaatatacaaaaaattagcctggcgtggtggcatacacctgtagttgcagctactcaggaggctgaggtgggaggatcaattgagcccaggaggtcaaggctacagtgagctgtgatcacaccactgtactccagcctgggtgaaacagcaagaccttgtccc

SEQ ID NO: 37968 - DNA, 311 bp, Homo sapiens
  misc_feature 24: n = A,T,C or G
aatggtccagcgtttgacataccnacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttg

SEQ ID NO: 37969 - DNA, 195 bp, Homo sapiens
  misc_feature 8, 59: n = A,T,C or G
accatatntcaggtttaaatgcttacaagatttctttgttgctgaaattctgtcgttgncctgtggcttataaaatattattgtggtttctttcactagaagaaacttttcatctgtagaacttcgtttttagttgaagtcattgagcctttctttacttgaaaagaaaattaagtacttttcttccagcatatg

SEQ ID NO: 37970 - DNA, 181 bp, Homo sapiens
  misc_feature 2, 7, 33: n = A,T,C or G
gnaaacnaactggtgtgagtcaaatgccccctnagtgactgcccccagcccaggccagaagacctcccttcaggtgccgggcgcaggaactgtgtgtgtcctacacaatggtgctattctgtgtcaaacacctctgtattttttagaacatcaattgatattaaaaatgaaaagattatcg

SEQ ID NO: 37971 - DNA, 235 bp, Homo sapiens
  misc_feature 4, 7, 79: n = A,T,C or G
attngcnttctttctctttctgtcccatggattctggcaatgctatacattcaagctgctctatgaacctgggttttanaatggggatgatgagtaacagagcctgacttacgctctgataagcatacaatgtacagaaagaaaaacatattttactatattaggcaactgagatttgggtgttgccttatgattgcagcttaatatatcccattctgaataatataggcaatat

SEQ ID NO: 37972 - DNA, 355 bp, Homo sapiens
  misc_feature 5: n = A,T,C or G
agcangcgcaacttagatattcaaaagtagagacaggagaagagctgatcccaagaaatgaggaggggccaaaggtgactattgtaacggggtaaaattgagaaatgccttgcaatctgtgatttcaagctacgagcatacagcagggcaaccagaaagatacatattccattattcaggagttgagtgtcccttcttgttatgccattatttctggtgcttttctctgcaggcctcatttgcaggggaaaaggaaagaaagacaactagaaaagaaagggaggaaataaggcttctccagttaagaaaatttacttctatcataggttttacattcaagggaacaattcataac

SEQ ID NO: 37973 - DNA, 399 bp, Homo sapiens
  misc_feature 7: n = A,T,C or G
ggaagangcgtgacggagaattcctgaggtgtattagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctg

SEQ ID NO: 37974 - DNA, 132 bp, Homo sapiens
tctcgatctcctgacctcatgatccacccgccttggcctcccaaagtgctgggattacggtcgtgagccaccgcgcccggcctaatgtgtccatttctaaaatatatatatatagtacaatatagtttccac

SEQ ID NO: 37975 - DNA, 280 bp, Homo sapiens
  misc_feature 4, 16, 44, 76, 100, 158: n = A,T,C or G
gatnccggctcatgcntgtaatcccagcactttgggagactcangcaggcaaaatcacctgaaggtcaaggggttngagaaccagcctggagaacatggngaaaatcccgtctctactaaaaatacaaaaattagctgggcatggtggtgtgcacctngtaatcccagccactccggaggcgaggcaggagaatcgcttgaacccgggagacggaggttgcagtgagccgagatcgcgccactgtactccagcctgggcgacagagcaagactctgtctc

SEQ ID NO: 37976 - DNA, 415 bp, Homo sapiens
  misc_feature 13, 17, 29, 38, 39, 69, 92, 96, 115, 135: n = A,T,C or G
cagtcacattagnatgntcacacggattngaaaaatgnntcacataatacactttttataaattttagnggaatggcaagccttacgtcaanaagnatatgccacataatgaagnatggccaaaaaccctagcgncacttgtaaccatttgtactcttatggatttgtgtcttacaccatttgccttgctttttaaatgactttgtttttcaaggtgctgtcattttgcaaaaggaaatctttatatgaaatgtacaaaaaccgttactaactggacaacagggaaggtgttggccccacattagtgcctgcccaccgctctacttctaaccagggacacggatcttccattctctacatccaccggactgcagcccaagtctggacctggctgcagtgggcatattaccgtatg

SEQ ID NO: 37977 - DNA, 470 bp, Homo sapiens
attggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcaccggactgtcagttctctgggaagtggtcagcgcatcctgc

SEQ ID NO: 37978 - DNA, 465 bp, Homo sapiens
gttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttaga

SEQ ID NO: 37979 - DNA, 172 bp, Homo sapiens
caagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggt

SEQ ID NO: 37980 - DNA, 439 bp, Homo sapiens
  misc_feature 9: n = A,T,C or G
catctcagnaacgttgtggattgagagagacactacatgactccaagtatatgagaaaaggacagagctctaattgataactctgtagttcaaaaggaaaagagtatgcccaattctctctacatgacatattgagatttttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacatttatgtttataattgcacatgtgcacataatctattatgatccaatgcaaatacagctccaaaaatattaaatgtatatatattttaaaatgcctgaggaaatacatttttcttaataaactgaagagtctct

SEQ ID NO: 37981 - DNA, 158 bp, Homo sapiens
  misc_feature 39, 156, 157, 158: n = A,T,C or G
ggacggaggcctgtggtactgggtgtgcggtgggcgtanccaggtggtagagcgagctgggtgcctcctcatggggtggtcggagcccggttgctcacccaggtactcgccctcacggccgaggggccattctgcttataaaagctgtgccaggcnnn

SEQ ID NO: 37982 - DNA, 162 bp, Homo sapiens
  misc_feature 9: n = A,T,C or G
aaatgatgnagtgttaaaacttctctattcatagccaggaataaggcaagaatggctgtcacactcttctgctcattgtgttataacttctactttagattgtactggaggttctagttgcagtgataaagctggaaagaaaaataaaaagtgtgaattttg

SEQ ID NO: 37983 - DNA, 486 bp, Homo sapiens
cagactctgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatag

SEQ ID NO: 37984 - DNA, 457 bp, Homo sapiens
attgatttttgtatttttttactttttgtatttaatttataaccatccccttactgaatcaccttattaattctattagtatttctgttgggtctcctggattttatagataggcattcacattatttgcagaaaagaacatattgttgtctcattttcctcaaaggttagtagttcttatttatttttcctgccttattgcattgtccagaacttctagacccatgaaaatagtcgtactgatagtgagaggcctagtgaaaattcagagacagttctggggcaggagccagatttgacccattcctatccctaccattgtctcttgagactctgttcactcatttgctcatttgtgaaacattttatgttgacttctctgggccaggccctgtgccagatactgagaccaaggatgacatatataggaggcttccagctcagaatttctcaatat

SEQ ID NO: 37985 - DNA, 242 bp, Homo sapiens
  misc_feature 155, 161, 174, 210: n = A,T,C or G
ggagtagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatganacaganacttaaggaaganaccctgtgagtctgacaataaaagatttggacaganacagaaagattggagagagagagagagggaga

SEQ ID NO: 37986 - DNA, 215 bp, Homo sapiens
atccaaacaacaaagtctaatatttcgcccactaagccaatcactttattgacccctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcct

SEQ ID NO: 37987 - DNA, 172 bp, Homo sapiens
  misc_feature 4, 7: n = A,T,C or G
aganccnaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 37988 - DNA, 145 bp, Homo sapiens
  misc_feature 110: n = A,T,C or G
gggataactaactcctagggataaccatttctatcctgttccaaagtcttattttatagtttgaaaagcactttgcacacagttcttgtatataaaagtaaagatgtaanttataggatatagtgttcctgctttgtttaataag

SEQ ID NO: 37989 - DNA, 478 bp, Homo sapiens
tatggccggggaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttat

SEQ ID NO: 37990 - DNA, 322 bp, Homo sapiens
  misc_feature 18: n = A,T,C or G
ggaaaactggaagacagnaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagc

SEQ ID NO: 37991 - DNA, 490 bp, Homo sapiens
  misc_feature 7, 9: n = A,T,C or G
gatcccncnggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacgtaggcttatatacaatgcttcttt

SEQ ID NO: 37992 - DNA, 216 bp, Homo sapiens
aaatctcactaattaaattttttaggatttatgtcaccaagttaattcattccttaatctctccacactcctttaaaattacttacctcttacttgtgtagattcagtctttgttatagaaaaattataatgaatgaaactaaatcttcagaaaaagtttattaaatcatttttgtggaatctgataaactaattctaaaatttattcaaaaaagc

SEQ ID NO: 37993 - DNA, 413 bp, Homo sapiens
  misc_feature 12, 14: n = A,T,C or G
agagacgcaagnanaaaaatccactgccttccaaagtaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccat

SEQ ID NO: 37994 - DNA, 215 bp, Homo sapiens
gtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacc

SEQ ID NO: 37995 - DNA, 318 bp, Homo sapiens
  misc_feature 26: n = A,T,C or G
aaggaagtcccttgccatcctaaaancaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccgt

SEQ ID NO: 37996 - DNA, 436 bp, Homo sapiens
gtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgt

SEQ ID NO: 37997 - DNA, 250 bp, Homo sapiens
ctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaga

SEQ ID NO: 37998 - DNA, 195 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccc

SEQ ID NO: 37999 - DNA, 466 bp, Homo sapiens
  misc_feature 17: n = A,T,C or G
tatggccggggggaccngactcggtccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcccctcatttaaaaatagaaataaagcattttgttaaaaacc

SEQ ID NO: 38000 - DNA, 136 bp, Homo sapiens
  misc_feature 18, 40, 44: n = A,T,C or G
aaatccccttgtaaattnaactgttagtccaaagcaggancagntctttggacactaggaaaaaaccttgtagagagagtaaaaaatttaacacccatagtaggcctaaaagcagccaccaattaagaaagcgttc

SEQ ID NO: 38001 - DNA, 426 bp, Homo sapiens
  misc_feature 14: n = A,T,C or G
gagatgaccccagnagagctgcagaagcgagtaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctagc

SEQ ID NO: 38002 - DNA, 470 bp, Homo sapiens
gaaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaaggga

SEQ ID NO: 38003 - DNA, 162 bp, Homo sapiens
  misc_feature 6, 7, 27, 44, 50, 55, 57, 58, 59, 60, 64, 71, 82, 83, 84,91, 96, 98, 102: n = A,T,C or G
tggatnnggagaaaccccgccggctcntaagacaaaatactctngtatgngagcnannnnatgnatgtggnccattctggannntacttgngcaantnggcntatagaggagtaacaacacatataataaatcacctcttccgctgttttagctgaagaatc

SEQ ID NO: 38004 - DNA, 146 bp, Homo sapiens
gacaaacagccaaatcatgagtgaactcccattcacaattgcttcaaagagaataaaatacctaggaatccaacttacaagggacgtgaaggacctcttcaaggagaactacaaaccataggatacaaacaaatggaagagcatcc

SEQ ID NO: 38005 - DNA, 230 bp, Homo sapiens
atatgacctacctagtcattgtcgtatccatagaaacagaaagagacagatggtggttgctaggtgctaggggaagaaagtagcagggacttgctctttattaggtattatggcgagtttcacttttgcaagatacagaattctggggactagtttcacaacagtatgaatgtacttaacaatactgaactgtacacgtaaaaatggctaagatgaaagttttatatgta

SEQ ID NO: 38006 - DNA, 242 bp, Homo sapiens
atggccgggctaccatcttaattaagaaagcagttgctgttcgaaagcatcttgagaggaacggaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaat

SEQ ID NO: 38007 - DNA, 181 bp, Homo sapiens
  misc_feature 58, 85, 112: n = A,T,C or G
gtagagatgggggtcccattacgttgttcaggctggcctcaaactcctgggctcaagngatccttctgcctcagcctcccaaagngctgggattatagatgtgagccactgngcccagccaggagcttttacataatcctttttgacaaattttcccccaagaaattagaaagttttatag

SEQ ID NO: 38008 - DNA, 294 bp, Homo sapiens
  misc_feature 5, 60: n = A,T,C or G
ggganccccagggtgcccctctgtcaacacccttgactcctgtgtttagaggggtggccngaaggaccttttctgctgggacaagacactgtactgccctctgctgggaaggggttttaataaacagaccctggcgcttgtgatgtaaatccccttgtggagtatttgccctctgtgtggctgtggcaagtggacatctctgagcttcagtttcctccagaaaatagctccattggtggtatctcctttgtttggtttggtgaagattaaattcgatgctctatgtgcataaca

SEQ ID NO: 38009 - DNA, 282 bp, Homo sapiens
caaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagctt

SEQ ID NO: 38010 - DNA, 324 bp, Homo sapiens
agagaaggagagcattacattggtggaatgcctgcatttgggttttttacatagaatcaacatggcagacggtacagaaaagccacggaagggtgggagtctttggctataaaatcaagagggggcctccactgccctgtcctgtttacacatttttctaataatgttgtctttaacaagaaaatatcatcaaaaccagctgtagtgtatgcctaactgtactctgcagctttccttggcagtctgaatctaaccgcagtgagtcagcctgttcaggtcccacccatcctggtgaacttttccacttgaatcttgaagtctttg

SEQ ID NO: 38011 - DNA, 119 bp, Homo sapiens
agggatggtgtttccagacttcttcaatcgtgtggttccagattttctgtggataggacatagttcctacggttaaggagcacacagttctgtgtacagttgtactgttaaccaagacg

SEQ ID NO: 38012 - DNA, 220 bp, Homo sapiens
  misc_feature 218: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtngc

SEQ ID NO: 38013 - DNA, 411 bp, Homo sapiens
  misc_feature 7: n = A,T,C or G
gaacccnatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagtgggttaaatgaaccagtgggggcaggtccctccaaccaccagcactggctcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctg

SEQ ID NO: 38014 - DNA, 113 bp, Homo sapiens
  misc_feature 33: n = A,T,C or G
cacagtggttcacgcctgtaatccccgcacttnaggaggctgaggtgggtggatcacctgaggtcaggagttcaagaccagcctggccaacatggtaaaactccgtctctact

SEQ ID NO: 38015 - DNA, 467 bp, Homo sapiens
aggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcaccccttttt

SEQ ID NO: 38016 - DNA, 381 bp, Homo sapiens
gaaatcactacgtctgaaggttaaaagtaaactttagtctaacattgtctcttatttagttcatctccaacaaactatgtgccaagcattgtgctacatggtagaatataacagtaaatacgacagaacaccatgacaggaaagtttaggttctagtggagaagacagacaaattaagcaactgtaatctggtatagtaagtaggaggatacacagggatacaaaaaaatacctgtctcagtcttagaattttagcatacatttcctgaaagaactgatggctaaactgagacctaaaagatgaatggcaactgacttggaaaaagtgagggactgagaaggaaagtgagaaaaatataacaggcagtgggaaaaagcaca

SEQ ID NO: 38017 - DNA, 466 bp, Homo sapiens
  misc_feature 6, 7, 13, 16, 34: n = A,T,C or G
gtaccnnaacagnagntatagaccaatggaacanaacagagccctcagaaataacaccacacatctacaaccatctgatctttgacaaacctgagaaaaacaagcaatggggaaaggattccctatttaataaatggtgctgggaaaactggctagccatatgtagaaagctgaaactggatcccttccttataccttatataaaaattaattcaagatggattaaagacttaaatgttagacctgaaaccataaaaaccctagaagaaaacctaggcaataccattcaggacataggcatgggcaaggacttcatgtctaaaacaccaaaagcaatggcaacaaaagccaaaatagacaaatgggatctaattaacctaaagagcttctgcacagcaaaagaagctaccatcagattgaacaggcagcctacagaatgggagaaaatttttgcaatctacccatc

SEQ ID NO: 38018 - DNA, 184 bp, Homo sapiens
  misc_feature 32: n = A,T,C or G
agcctgggtaatatagtgagatcctgtgtctntataaaaaaattaaaaattagtcagttgtagtgacacacacctgtagtcccagctactcaggaggctgaggtggaaggatcacttgagcccagaaggtaaggctgcagtgagctgtgactgtgccactacactccagcctgagtgacagaga

SEQ ID NO: 38019 - DNA, 144 bp, Homo sapiens
gtggtcaggagttgtttctgacccactgatctctactaccacaaggaaaatagtttaggagaaaccagcttttactgtttttgaaaaattagcttcaccctgtcaagttaacaaggaatgcctgtgccaataaaaggtttctcc

SEQ ID NO: 38020 - DNA, 366 bp, Homo sapiens
  misc_feature 6: n = A,T,C or G
tctctncagaatttaatgtaactccaaccaaaatctaagcaggactgtttgcagatataaacaaaccaatttctaaaatttatgtgaaaaggcaaagcaactagaataggtaaaataattttgaaaaagaagtgtatatttgaagaaatcaccaatcgccctacctgattttaacacttgctataaagctatagtaatcaagacagtgtcatattggcaaagggatagacacatagatcaatggagtagactagagtccaaaaatagacctacaacaaatatggtcaattgctttgatagaggtacaaagacaattcaatggagaaggagtcttttctacaatggtcttggaacaattggacatcc

SEQ ID NO: 38021 - DNA, 257 bp, Homo sapiens
  misc_feature 8, 25: n = A,T,C or G
cagtggcnggaagaacggtctcagnaactgtttgtttcaactggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 38022 - DNA, 207 bp, Homo sapiens
  misc_feature 5, 31: n = A,T,C or G
aggancgtggtagcctcacttttaatgaacnaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttcagga

SEQ ID NO: 38023 - DNA, 106 bp, Homo sapiens
  misc_feature 31, 32: n = A,T,C or G
atatgacgaattcgtacagatgatgactgcnntatgaagacctactttcaactcctttttcccccctctagaagaatcaaattgaatcttttacttacctcttgcg

SEQ ID NO: 38024 - DNA, 246 bp, Homo sapiens
  misc_feature 18: n = A,T,C or G
caagaaaggcaaaccagnagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 38025 - DNA, 437 bp, Homo sapiens
cataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattcct

SEQ ID NO: 38026 - DNA, 161 bp, Homo sapiens
gtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttt

SEQ ID NO: 38027 - DNA, 393 bp, Homo sapiens
ggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttg

SEQ ID NO: 38028 - DNA, 322 bp, Homo sapiens
atttctcgtgctgcgcattcactcttgtagattagagttttatcttgtgtcatttcctttcagcctaaagaacttattctgtcatgtcttgtaatgtggatctgtctgcaatatattctctcaggttttgtttatctaaaaatttctttattttaccttaattttagttaaaaggcattttctctggttgaaaatcatattcttggccaggcacagtggcttacacctataatcccagcactttgggaggcagtggctgaaggataacttgagcccaggagtttgagaccagcctaggcaaaatagtgcaacccctgtctct

SEQ ID NO: 38029 - DNA, 276 bp, Homo sapiens
cagagtggctcacacctgtaatcccagtactttgggaggccaaggcaggtggaacacctgaggtcaggagttcgagaccagcctggtcaacatggtgaaaccccatctttactaaaaaacacaaaaaacagccgggagtggtggcgggcgcctgtgatcccagttactcaggaggctgagacaggagaattggctgaacccgggaggcagaggttgcggtaagccaagattgtgccactgcacaccagtgtgaacaagggagtgagactccatctc

SEQ ID NO: 38030 - DNA, 123 bp, Homo sapiens
gatccaccgtctggtacaactgtccttagactgatgagcaaaggaggagtcaactaatgaagaaatgaataataaattttgacactgaaaaacattttattaataaagaatattgacatgagc

SEQ ID NO: 38031 - DNA, 212 bp, Homo sapiens
  misc_feature 17: n = A,T,C or G
tatggccgggggtcatnaagattgctaacccagtatgaagcaaaacaagagttaattgcatggactgagctaatagaggactgaactgattcttttgtggcttttttggtttgaaacattgctgattctttttgttgttcagtgtcaaattttttttctcttgagctatttgtagcccttaacaattgagtatactcttgtaaataaaattt

SEQ ID NO: 38032 - DNA, 437 bp, Homo sapiens
ggattcctgaagctgacagcattcgggccgagtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 38033 - DNA, 458 bp, Homo sapiens
  misc_feature 144: n = A,T,C or G
atggccgggaaagtcttagaatggaaaaagtaaagaaatatcaacttccaagttggcaagtaactcccaatgatttagtttttttccccccagtttgaattgggaagctgggggaagttaaatatgagccactgggtgtaccangtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaacgatcctgaagggatttcttctgatggtagcttttgtattatcaagtaagattctat

SEQ ID NO: 38034 - DNA, 438 bp, Homo sapiens
  misc_feature 9, 20: n = A,T,C or G
tcgggatgnatggggaaggnccccgctaactaagcagtgagcaagaaccatcaatatttggagccagacttttatatttaagagtttcagttcttttctgaagcctgggctactagttgagctcacaccctcttaaagtgggggtataatgctttacactggaaaatctcaaatagctaaaagatgttttcctataacgccatccatctctgtactttaagttggactcctagaggtttctgaggcagtcacaagtttaaattcaccactgttttcatgaatatttgtgacatttctcccgcattgttaacctctcttggtccagtgtatgatgtcccactcagcctctgtgctgaaataattcctctcctaggtttcttcccagccctagacaaggaggaaacagcacagaggggttgggaagagtagtctagttct

SEQ ID NO: 38035 - DNA, 485 bp, Homo sapiens
atggccgggctgtctcttattcattgttatgttctggcacctggtacagctctaagtgacaaatattctatgaaatcaagaattcacttacctacaactcttccctatgataataagtgaaaagaacattcagacactgagggtctctgtatgaaaattaacatataatctcccaagtgcttctagtgttatgattctactcatggggggtcagctagaggtggacagttttaaccatgcactctgaggttcatacccagtttacataactgagaacactaccaatctaaagattatgaagataatgcagaatgatttttagccactcctcaaactgtgctcacttttgtggacattcatccagtctcctgaaatgatttattcccatgtctgtctccttcagtgcactgtgagctactcaaaagcaggaaccttgtctttttcatccttttctgaaacctagtgtcctctggataaatgtttgc

SEQ ID NO: 38036 - DNA, 466 bp, Homo sapiens
ggagcatttcgctcgcgagaatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattcta

SEQ ID NO: 38037 - DNA, 107 bp, Homo sapiens
  misc_feature 7: n = A,T,C or G
cgcaggnaactgtgtgtgtcctacacaatggtgctattctgtgtcaaacacctctgtattttttaaaacatcaattgatattaaaaatgaaaagattattggaaagt

SEQ ID NO: 38038 - DNA, 165 bp, Homo sapiens
  misc_feature 34: n = A,T,C or G
attcgcccaaagaaaataaagagaagaatgggcnaagaagtaatcatgtagttgaagtctgtggatgcagctgttatgaagatggttaaacttgaaacaaacaattttaagaattatttggtctgaagatgttttactttaaataaatgtctattgtaatggctg

SEQ ID NO: 38039 - DNA, 490 bp, Homo sapiens
  misc_feature 31, 487: n = A,T,C or G
gtttttccgtggagctgtcgccatgaaggtngagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcaccttaagcaaaagattgtgaagcctgtgaaagtttcagcttccccgagttgggngga

SEQ ID NO: 38040 - DNA, 158 bp, Homo sapiens
gactcttagcggtggatcacccggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgt

SEQ ID NO: 38041 - DNA, 476 bp, Homo sapiens
tatggccggggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 38042 - DNA, 217 bp, Homo sapiens
  misc_feature 7, 35: n = A,T,C or G
gaagggngtcaccaaaaactgggaagatgtaccangagaccaggtcaagcccgaccaatacactgaggccctggcccagagggacaagatctaaaaaaaataatgctgggaagtcctaaccacatcaagaatgcctcagatcagtggcccaaggaccttccagaatggatgaaatagacccaaagctgaattcacctaattttagggccaaaaacct

SEQ ID NO: 38043 - DNA, 469 bp, Homo sapiens
  misc_feature 365: n = A,T,C or G
gaatttcggtacacaaataattcaaaagcaaaaaatgaaatattaatgagaattgttagttctcctgggataattattaagaattcttaattcttctgatttgaagaagtaagggaatgaaaaatggtaagatggtaactggctgtggtgcaatgaaggatttacttaagcaaaaaaaaaattttcttttttgggggatagggtgttgctatgttgcccaggctggtcttgagctccagggctcaagtgttcatcctgcctcagcatcccaaggagctgggactacaggtgtgcgccactgcacccagccaaccttagcacattttaaaaaattatagattaaacttttttgggccaggcatggnggcttacacctgtaatctcaccactttgggagggcgaggtgggtgaatcacttgaggtcaggagttcaagaccagcctggccaacatgacaaaaccctgtgtct

SEQ ID NO: 38044 - DNA, 223 bp, Homo sapiens
  misc_feature 35, 217: n = A,T,C or G
tatggccgggcagctctcacagtgaagagccaagnaaaacacaacacaacaaaacatatatttagtattcttaaaaagtcaaaagttcagagttcggtcaatagatttaatgtagtccctaccctgtcaaaatttcaacaatgttttttgtttgtttcatcgtttttgtggagatggacaagctaatcttaaaattcgtatggaaatgcaaggggancctgag

SEQ ID NO: 38045 - DNA, 469 bp, Homo sapiens
  misc_feature 376, 429: n = A,T,C or G
cataggccatagcctctttactattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggntgactctctctgggagactcttggtccaagacctgggtcagttctttgctggnggtcccctctgaccacaagcttctgcctgaagattcctca

SEQ ID NO: 38046 - DNA, 200 bp, Homo sapiens
  misc_feature 2, 20, 40, 100, 148, 171, 181: n = A,T,C or G
tncgggggaagttaagtggnacgagaatgtaagcagcatnatggaggtttgaagatgccgcatttggattggatgaattccaaattctgcttgcttgctntttaatattgatatgcttatacacttacactttatgcacaaaatgtangggtataataatgttaacatggncatgatcttntttataattctactttgag

SEQ ID NO: 38047 - DNA, 480 bp, Homo sapiens
  misc_feature 18: n = A,T,C or G
tatggccgggatagaccntgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttaccgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatc

SEQ ID NO: 38048 - DNA, 485 bp, Homo sapiens
  misc_feature 35, 355, 431: n = A,T,C or G
caaacaccaagagagagaacgcattcgactgcttnaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcatgagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggantgtgtttgccacttgatgccatcctggccacgctgatgagctgtacccgctcagtgtattcctgggatattgtcgnccagagagttgggtccaaactcttctttgacaagagagacaactctgactttga

SEQ ID NO: 38049 - DNA, 253 bp, Homo sapiens
gtttgccaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttcc

SEQ ID NO: 38050 - DNA, 244 bp, Homo sapiens
  misc_feature 8, 12, 29, 48, 241: n = A,T,C or G
ctcggccntttntggaccggggcaagggngtcacccagaaaactgggnaagtatgtaccatggagaccaggtcaagcccgaccaatacactgaggccctggcccagagggacaagatctaaaaaaaataatgctgggaagtcctaaccacatcaagaatgcctcagatcagtggcccaaggaccttccagaatggatgaaatagacccaaagctgaattcacctaattttagggccaaaancct

SEQ ID NO: 38051 - DNA, 473 bp, Homo sapiens
ggtactacgggcacccaccaccacgcccggctaattttttgtacttttagtagagatgaggtttctccgtgttagccaggatggtctccatctcctgacctcgtgatccgcgcgcctaggcctcccaaagtgctgggattacaggcctgagccatcgcgcctggcccggtctgttcttatataatgaacaaatttgaagtaactaagcatgtgaatatctggaaaagataaacaaatggctattagttcaattttggaaaataaaagattttcaacaagttcttagccaaaattctattgccaaagtttagttaaaatgacatattaaggaactgggggaaatctattttcatgactgggggaaatactttagttatttaaaaaatgcagaggtaaaatgtagcttttctgaatggcaaactacatgaactaatattccttagggaaataatttattatctcctttatatctt

SEQ ID NO: 38052 - DNA, 106 bp, Homo sapiens
  misc_feature 6: n = A,T,C or G
atcgtnaagctgttcaaaaataactcagacccagtcttgtggatggaaatgtagtgctcgagtcacattctgcttaaagttgtagcaaatacagatgagttaaaag

SEQ ID NO: 38053 - DNA, 369 bp, Homo sapiens
  misc_feature 33: n = A,T,C or G
ggcttataaacctcagccctgaggctccagctnactctaccccatctccttgccgggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggcc

SEQ ID NO: 38054 - DNA, 385 bp, Homo sapiens
ggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcac

SEQ ID NO: 38055 - DNA, 469 bp, Homo sapiens
aagaattctgagcacgcctcttctgaaaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatg

SEQ ID NO: 38056 - DNA, 163 bp, Homo sapiens
cagaactgtttgtttcaattggcctttaagtttagtagtaaaagactggttaatgataacaatgcatcgtaaaaccttcagaaggaaaggagaatgttttgtggaccactttggttttcttttttgcgtgtggcagttttaagttattagtttttaaatcagt

SEQ ID NO: 38057 - DNA, 466 bp, Homo sapiens
cttctctcttcctcggcgctgcctacggaaggtggcagccatctccttctcggcatcatggccgccctcagaccccttgtgaagcccaagatcgtcaaaaagggaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagcttggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtag

SEQ ID NO: 38058 - DNA, 470 bp, Homo sapiens
  misc_feature 11, 16: n = A,T,C or G
atccaacaatnagagnaatgagatgattttgcattcaaaacagaagaggaaaatatgtcttttagttagaaaaggagttaaaagaactagttaaccattcagaaatgagtaactgatttttaaaaagtagatggaaagtaataagaatatacattaatgaactaggaaataatacaattatgggatcaagaatataaaagttgatattctgaaaaaacaaataaaattgacaaactatcatagaggttaggttccagatgagcacaccaggtataaacttccagactcttaaggcctgggctcagagatgggtacatcattactttcagtttattccgttgtattctgtttatcaaagagtcacagattcagattcatatacccacttctcaatggaaggagtgttgaagaatttggagaccatgttttaaaactagcacagcaaattctaccaaatattcaaatgtttg

SEQ ID NO: 38059 - DNA, 470 bp, Homo sapiens
  misc_feature 168: n = A,T,C or G
attgttaatcaaaatctaagtgtcatgatgtcccttgtcaccaggaagtctcactcccaggtagtgctgtcccatgttgatgagggaggaaatgtctcagtgaggaattttaagagttcccaaaagctgacttaggatggcatcacagagtggcagaaatgagacctnagttaagtcattgatttatgtaagtcattgcttgttgaatcatccctagtctttggaatcccatgattttagtttcctccaaagtaaaacaatgagagatacataacattaagaatttgtattgcagaaatataatgcacacattgactacaatcaaaaagtgaatttacatgtcagaatgaaaaaagaacctattcattagggagccaacaacaaaatcttgaaaaaaattaaaacctggttcttctttacagactggttgtagccaggaaataattcaggatttagtccaagaggtagac

SEQ ID NO: 38060 - DNA, 311 bp, Homo sapiens
  misc_feature 4: n = A,T,C or G
gacnacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctgg

SEQ ID NO: 38061 - DNA, 480 bp, Homo sapiens
gggccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatcctt

SEQ ID NO: 38062 - DNA, 350 bp, Homo sapiens
atttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttt

SEQ ID NO: 38063 - DNA, 345 bp, Homo sapiens
  misc_feature 11, 25, 26, 33, 40, 43, 52, 64, 67, 75, 99, 119, 176, 271: n = A,T,C or G
ggcaaatgctnacaagaactaaggnnagaccgnttttatntgnaaacagtanagggttggtctncanggagatanattccctgatttctcaagggggtnactttccctctcaccgagtnaaatctggctctgttatattttttccaggaacacagtatgtctcttcccaatgtttnattcggtttctggtttccccacttttgaccggaagtatgtgggaagaatactggctgttattattatgattattgagtgtccaatactctcctcnaatatttccaccaagaattattatcgctgctctcctcattcatgttagtgttgctaatgtgtgctttagatgac

SEQ ID NO: 38064 - DNA, 447 bp, Homo sapiens
atggccggggattccctccaaccctagatcctgtgaaactatgataattctgtgatagcccagtggagaaagcataacagaggtgccattggccacttggtggcaatacatcctaattgcgtgtaaagttctgaaacggtaataaacagcatgctaacagacttggaagctaatttatgcagacatttcaagcagtttacaggtgccttagttggaaaggtcagctaaatgcttaatatcctttaaaggtgcattagaagcaaagcaaaacataccttgtgtttgccaaaagtatttgtgggtactctctaggaaattctattaggaaatatctttggagctagaaaagattcagagggaaagtaaaactgctgacatagtagcaataaccaaaaaatacatagactgtaaagagatttcattaataatattaagaacctaccactg

SEQ ID NO: 38065 - DNA, 479 bp, Homo sapiens
  misc_feature 174: n = A,T,C or G
atggccggggaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctnggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgt

SEQ ID NO: 38066 - DNA, 123 bp, Homo sapiens
gtaggtgtatgtgtgtactctgcacgtatatctcttctgtcttgaagaccctgttaactttgtgaaataacttccacatttcaacacacttcacagtacaggaaataaagtaatatgaaaaac

SEQ ID NO: 38067 - DNA, 436 bp, Homo sapiens
  misc_feature 35: n = A,T,C or G
ctggagccaagaagacacattcctagttccccgtnaacttcctttgacttattgtccccactaaaacaaaacaaaaaacttttaatgccttccacattaattagattttcttgcagtttttttacggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaataggctgtacttattttcc

SEQ ID NO: 38068 - DNA, 491 bp, Homo sapiens
  misc_feature 9, 34: n = A,T,C or G
agaacaccncatttaagaggcattctttctcatntgctgatgattttcaacttgctcaccaactgagttgctgaatggcttcctacgatttgcaccctgtttgcttcactgttaaggaggcactcctggagattagcaatagcaggaacccaccgttgcaatagcagtgagccctataggctggatggacaaagaaagaagcagtgttactggagcccagcatccagagtcactgtgagagagctggaaccatgctgggcctgtccatggtcagcagaaggcattggaggacacaaagaaaatatgggctctacttgagataccacccaaagctgttagtgggaaatattatgacttcttcctaacaccagagcttactgttggctgaactctgtaggaatccagctgatatgagaactggggaaatgcatcctgaaggaatcagtctcctgtgatgaagagcaaagacgtgacggacaagaaagaactct

SEQ ID NO: 38069 - DNA, 197 bp, Homo sapiens
tagaatcttagttaactttaaatttgcccacagtaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 38070 - DNA, 477 bp, Homo sapiens
  misc_feature 420: n = A,T,C or G
atggccggggttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatagtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatganaccaggtgttgcttgttcagtatctcaagcccagaaagatgaattaatccttgaagg

SEQ ID NO: 38071 - DNA, 313 bp, Homo sapiens
atcattcactattcctaaaggcctaaaaataacactggccatatgaaaatcaaaacacagaaatctgctgataaagcctcagtgtctactttgcaacaaatttgtaaaaaatgtcagcttttaaaggtttagcaaggatggacatggtggttcatgcttacaatcccagcactttgggagggtgaggtgggaggatcgcttgagcccaggagttcgagaccagcctcggcaacatggtgaaaccccgtgtctacaaaagatacagttgtggtggcacatgcctgttctcaaaatagcaaagccccatctctat

SEQ ID NO: 38072 - DNA, 241 bp, Homo sapiens
ggaaaaacggttccacagtgaaataactttggacaccattgcgtatcagttgttccctcttagaaattcagattgtactttggaatgttaaagactctgaaaaaagaaaaagctgatttaacttttttagcctacgacaccccaaaatcacattaggcacagaaggctttttgtaaagagcgtcattagcttctgagaaactagttttctgtaggacactgggaaatgtttctggttattt

SEQ ID NO: 38073 - DNA, 469 bp, Homo sapiens
atactttaggagccatatgtgttttcacattcagagttttgaattctaggcttttttgcccctaggaaaaagtcttttgttggtaattaacacatttgactgtagcttatgtatgtatcattcccaaatctcaaattcaacacgttaaaaacgtctctcagtcactcctgttttccttatcccagttaaagggataccatttactctgtcccttagcctcccaaagtgctggtattccaggcatgagctactgtgcccagcctaaatataacttttaaaaataaaaatgaggaagaaaggtcgttatacataccttatgattatatataaaacgtcaatgcttcatatctggattaaaaaagaaaaacgaagacagactgaagagaaacatatggctaaggctgaggctaaggcctggctgagttagaaaggactaaaataggttacttatatttttctatttcagcta

SEQ ID NO: 38074 - DNA, 326 bp, Homo sapiens
  misc_feature 34: n = A,T,C or G
caggaagcccaaaatcaagagtgagatgtagaangttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgc

SEQ ID NO: 38075 - DNA, 370 bp, Homo sapiens
caggagcttgaggctgcagtgagctgtgattgcaccactgcactcccgcccaggaaacagagagagaccctatctcaaataaatgaataagtaaataaataaaaataataaaataatgcatgcaattagtacactagtacatgatcaggcacatgataactgctcgataaatggtagcctcagtaaactttataatgttttaaaggagaatgtcctttggactcagcctttcaaatgacagagcatttgaaaagactgatttgtatgatggctatttcctacagatacaagactgtacctccagggactcaaggcattggctcagtggggcaccttgttctgtttactcttgttttggtcagcaccgatt

SEQ ID NO: 38076 - DNA, 175 bp, Homo sapiens
  misc_feature 19: n = A,T,C or G
attgattgtcttatatttnaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaaccc

SEQ ID NO: 38077 - DNA, 469 bp, Homo sapiens
  misc_feature 7: n = A,T,C or G
gggtgcngtcgcgaatctggtatgtttgtacgtctccagaggcagctgaaaaaaacagtgagcatggtgtaagacagaaacattgcaacttgattcaattatgtgtatcaatcatcaatctaagcatgtattttggactaaaagggaaacaaaaaagaaaagatgattctggctaaagcgttgaaagaatcagcactcttcgcgccactactaagaaataattcccaatgtaatgtatttattacagtaacctatgtccgctggatcttacattttatttttcatttgaatgcagttctattctgttgttaacatgcttaccaaccttaagtctaaaaggtaagtggggcacagcttggatgatcttcctagatagagtatagtcctcagtgtcttcctttgatattggtaaattcatattaaaaaatttcaagtagactcttgccacgacataaaaacgaccatgatt

SEQ ID NO: 38078 - DNA, 359 bp, Homo sapiens
acacatttgaaactcaaaaatcactgagaaaagcagtagacttccataaatattttatagagtagaaaaaataggccgggcacagtggctcatgcctgtaattccagcactttgggaggccgaggagggtggatcacgaggtcaggagttcaggaccagcccggccaagatggtgaaaccccatctctactaaaaatacaaaaactagccaggcgtggtggcgggtgcctgtagtcccagctacttgggaggctgaggcggggaattgcttaaacccttaaatccgggaggtggaggttgcagtgagccaggttcgcaccactgcattccagcctgggcgacagaacgagactctgtct

SEQ ID NO: 38079 - DNA, 130 bp, Homo sapiens
  misc_feature 7: n = A,T,C or G
caggcgnctcagctttcctcctcctttaccctttcagatacaatcacgccagccacgttgttttgaaaatttctttttttggggggcagcagttttcctttttttaaacttaaataaattgttacaaaat

SEQ ID NO: 38080 - DNA, 176 bp, Homo sapiens
  misc_feature 7: n = A,T,C or G
gaaagtntttggagtcatcttccttacatttttttctctaggatgaagacaacacctagccaggcatggtggctcatgccagtaatgccagcactttgggagaatgagttaggataattgcttgagtccaggagtttgagaccagcctgggcaatgtggcgagactctgtctctac

SEQ ID NO: 38081 - DNA, 171 bp, Homo sapiens
  misc_feature 11, 21, 26, 27, 42, 58, 75, 112, 168: n = A,T,C or G
ctctgctcctnacgatgaagnctggnnctattcacagcagcngtctgccctcagtggncaggcgtgctattttgntctgcgccacataaccgttctgaagcttttaggcgtnggagaggaagttgggggagtgttagaactgttcccaattaatgggagctctgttgntgg

SEQ ID NO: 38082 - DNA, 486 bp, Homo sapiens
atgactgcagggagggaactatttctaaaataagaatttctatttattaaaagttagtgaaagaataatccccaacttggaaaagacttttaccatgtatataactgacaaaggattagcatgagatatataaagaattaatatgaatcaataagagaatgatcccaccctgtccttggggcccgtggaacactgtgctagcaggctgaacaattttgcgggaatatgggaatttttctttggacgcagtcatctcattcctatgaatgtatccaaatggagcctccccctagaaagagagggggtatttgattaaagatgcatattgcagcagtgcagcaaaagtactgaagctttcatagtgtccactagtagcaggtaacaagtcctgcttggatactactctaagtacaggacacccactcaatggaataatatggagtcatcttataattatgaagacttgtcatgacatgacatcatatt

SEQ ID NO: 38083 - DNA, 248 bp, Homo sapiens
  misc_feature 26, 34, 239, 246: n = A,T,C or G
attgagcacattaagtcactctaagnagccgagnatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaataaaggacctntgggctncg

SEQ ID NO: 38084 - DNA, 174 bp, Homo sapiens
  misc_feature 51, 92, 129, 145, 153: n = A,T,C or G
gtgtctaccatgtgtatgtattcttgacaagcagtataaaatacctgtggnttttctttacattagggataatgcctaaggaattaatcttnatatatattatcatccctaatgtggcagggggaagtntttaattgcccatganatgtatgngacttatactatgcccgagag

SEQ ID NO: 38085 - DNA, 352 bp, Homo sapiens
  misc_feature 18, 315: n = A,T,C or G
tgatggcccggggaatcnctcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggngtcagatgaatatgagcagctgtcctctgaagccctg

SEQ ID NO: 38086 - DNA, 272 bp, Homo sapiens
  misc_feature 13: n = A,T,C or G
atggaccggggangtccatctcatcccaccctctcacagttcggtacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtg

SEQ ID NO: 38087 - DNA, 489 bp, Homo sapiens
aactgcaagcaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctc

SEQ ID NO: 38088 - DNA, 144 bp, Homo sapiens
aggcgtggtggtgtactcctgtagtcccagctactcgggaggctgaggcaggaggattgcttgagcccaggtggtcgaggctgcagtgagctgtgattgtatcactgtactccaccatgagtgacagagtaagaccctgtctca

SEQ ID NO: 38089 - DNA, 371 bp, Homo sapiens
  misc_feature 251, 332, 345: n = A,T,C or G
aaagcccagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggacctgggggnacccccattggaacattcctttggtatcagacccgaagcgcaccattgctcaggattatggggtcttaaaggctgatgaangcatctcgttcangggcctttttatcattgatgataaag

SEQ ID NO: 38090 - DNA, 128 bp, Homo sapiens
aacactaatacatatagagagcggaaccataactcattgaattttggagaggaataagcttagcgttaatattgacaatattaaggcaatattcttgtaggaatactatgtgcatgtttgatattttg

SEQ ID NO: 38091 - DNA, 414 bp, Homo sapiens
aggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatattgacatgagc

SEQ ID NO: 38092 - DNA, 418 bp, Homo sapiens
  misc_feature 31, 389: n = A,T,C or G
gtagtaaagcattaggagggtcattcttgtnacaaaagtgccactaaaacagcctcaggagaataaatgacttgcttttctaaatctcaggtttatctgggctctatcatatggacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaaagttgtggaaaaagctaattgtagttttcattatgnaagttttcccaataaaccaggtattctat

SEQ ID NO: 38093 - DNA, 487 bp, Homo sapiens
atcattgaagttcttaatgctgactctactattgggttgttaatagtcttctcttgacatgactctttatgcaacataacatacatttggtattcttcagggtttaaaagaaaacactgagctgtttcctccaagttttattaaccttttatttaacttactgctttatttttttctcttttaatatggttattgttaaaatgagagtcacttgctagactggtctctttaaatgtaaggtctagtatcaatatttacttcattcaagtggaataaatggctttttgtagttacttccagttttcctcaagaatagaaataagtctgttcataagcaataccttcagttttgttcagttcacttccacgttaaataaagaataggattattcactggtaataatagagtcattaagaaatattaagcattgcagctaaaaattgaacaaccctgtaatgatacatttaagaattattcaaaggtgct

SEQ ID NO: 38094 - DNA, 475 bp, Homo sapiens
  misc_feature 30: n = A,T,C or G
atatttgatcaattttcttcccaccttgcnttacaacctctaacttaaatgggtaaccctaaggcctatcaaagaagcagattgcatgataaacggaaatagaaaaaaagaacctacatttattttgctttagcatccttactctcaccttttatgagattgagagtggacttacatttccttttttacattttcgtatacttattttttttagccatcattatatggtttaagtctattatgggcaaccaatctttggaagctgaaaactgaatttaaagaatgctatcttggaaaattgcataccgtctgtgcaattttttattctgcctagtgctattctgcttgtttaactagattgtacaaaataacttcattgcttaatatcaaattacaaagtttagacttggagggaaatgggctttttagaagcaaacaattttaaatatatttttggttcttcaaataaataggt

SEQ ID NO: 38095 - DNA, 348 bp, Homo sapiens
  misc_feature 4: n = A,T,C or G
agcnagagcaatcagacaaaagaagaaatgaagggcatccaaattggtaaagaggaagtcaaactgtcattgtttgctgatgatatgattgtttaccttgaaaaccctaacgactcctccagaaagctcctagaactgatgaaagaattcagcaaagattctggatacaagaatcagtagctcttccatacaccaacagcaaccaagtggagaatcaaatcaagaactcaacccctttacaatagctgcaaaaaaaataaaatacttaggaatacacctaaccaaggagtcagaagacctctgcagggaaaactatgagacactgctgaaagaaatcacagacaacac

SEQ ID NO: 38096 - DNA, 482 bp, Homo sapiens
gtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaactt

SEQ ID NO: 38097 - DNA, 464 bp, Homo sapiens
  misc_feature 9: n = A,T,C or G
ctccaggcngtctacaaaattggtggtattggtactgttcctgttggccgagtggagactggtgttctcaaacccggtatggtggtcacctttgctccagtcaacgttacaacggaagtaaaatttgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgccgccattgttgatat

SEQ ID NO: 38098 - DNA, 131 bp, Homo sapiens
gagaaagtaaattgaaagatatcccatgttcacggatttggaagaattagtattattaaaatatcagtactacccaaagtgatgtacagattcagtgcaatctctatcaaacctctaatgtcatttttcac

SEQ ID NO: 38099 - DNA, 194 bp, Homo sapiens
  misc_feature 4, 6: n = A,T,C or G
aganantggggaagcccagccggactaagacctgctgctgacttccatctgctgattctcacatgaggcctagcagggagaagcctcttgtccaggttagctcaggcctcctgagtccctgccctcctgagcacgtttggcaatggccttggcaggggctgaaacagcagtaactgcagttaggagcacctagc

SEQ ID NO: 38100 - DNA, 499 bp, Homo sapiens
  misc_feature 3, 57, 78, 105, 116, 119, 408, 452, 453, 455: n = A,T,C or G
tcnggcccggggagggcaccccggtgtcttctttagtcagagtccagacaacccccntcagggttgttttcagtaaangcccctggatgttgattttctggaacntggaaccctantantcccactgattgatttctacacagtgctgggttcacaggcctgccctggggggctggcttactctgtgacatactgagggtcagggcatttttcattcaaaaagaggaaaacacttttagttttctattactttatctatgactgtaggttttgacctcagctgtcatggatataaatatgtaagtagaatctttatggttataagatgatctgttgataaagtatagtcagcacctgatttacttcaaatgtcagatacttaacttgagatatccttaaattaatatnatttaattgggataagtcctaattgtatattttttattgggggnncnctggggacaaataattttaaaaactgtaaaaaatggactcagta

SEQ ID NO: 38101 - DNA, 293 bp, Homo sapiens
  misc_feature 213: n = A,T,C or G
caaaatgtgattgttgaagtacaaaaggaactctgaaaaccagaacaaattttaacaaaaggacaaccacagagggatattagtgaatatcgtatcattgtaatcaaagaagtaaggaggtaagattgccacgtgcctgctggtactgtgatgcatttcaagtggcagttttatcacgtttgaatctaccattcatagccagatgtgtatcangatgtttcactgacagtttttaacaataaattcttttcactgtattttatatcacttataataaatcggtgtataatttt

SEQ ID NO: 38102 - DNA, 148 bp, Homo sapiens
agacatggttgggaagacgtcaccaaaattaacaaaactgagatatgttcccagttgtagaattactgtttacacacatttttgttcaatattgatatattttatcaccaacatttcaagtttgtatttgttaataaaatgattattc

SEQ ID NO: 38103 - DNA, 411 bp, Homo sapiens
  misc_feature 42, 410: n = A,T,C or G
cttgataaaaccccctcaaaaaactgggtattagaaggaacntacctcaacgtaataaaagccctatatgacagacccacagctagtatcactactgaatgaggaaaaagtgaaagccctttctctaagatctggaacaagacaagactgctcactttccacccccgttattcaacatggtacctggaagtcatagctagacaatcagacaaaagaaagaaaggacatccaaattggaaaggaagaaatcaaattatccttgtttgcagatgatatggtcttacatttggaaaaaacaaaagactttatgagaaactattaaaattaataagcaatttcagtatagttgctggagttgattttttgtacaaaatcaacctacaaaaatcagtaggatttccatatgacant

SEQ ID NO: 38104 - DNA, 481 bp, Homo sapiens
attatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacat

SEQ ID NO: 38105 - DNA, 401 bp, Homo sapiens
  misc_feature 2, 399: n = A,T,C or G
anttacggccggggtgcgaaggcaggagttgagagtaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagcttgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaantt

SEQ ID NO: 38106 - DNA, 200 bp, Homo sapiens
  misc_feature 200: n = A,T,C or G
ggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgccn

SEQ ID NO: 38107 - DNA, 485 bp, Homo sapiens
catttaccaaaataccactgcaaagtagtaacaaatatgaatagaaatggtgaaaagaagtaatattatttagttaagaaacctgagaacagatttctttgattttcatgagtgctcaagccctaagctgatgcaaataatcacaactgtattttgtttccttgagctttaactagtagcatgtactcaggttacgtataaaaaccatgttgaagaacttctctttgggtttatataaatttgagtccttcccagaaataaggcataaacatcttgatttttcaacaatggtttgaagttgttattaaatatcattaccttcacgcctgtaatcccagcactttgggaggctgaggcgggtggatcacgaggtcaggagatcgagaccatcctggccaatatagtgaaaccccatctctactaaaaatacaaaaattagccaggcatggcgggtgcatgcctataatcccagctactctggaggc

SEQ ID NO: 38108 - DNA, 285 bp, Homo sapiens
tgaggaaatggagacagaatatacaaataagtcttgcaaaagttttactataaaaaggggagatatatgaacatgtggtcaaaaaagagtttttggttcatgtaagatcagagataccagggcatctgtgaggctgatgagaacgatccaatagaaagggagagattgatgacgcaaaactgagagaggagaaatgaggagtgaattcttcaagaaggcaaggggctatgtgtgagcattggcctttcacagaagcaggaaagcttgttctgtgtaacaattggg

SEQ ID NO: 38109 - DNA, 481 bp, Homo sapiens
  misc_feature 368: n = A,T,C or G
ctggcatgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtctgggcaacatggcgaaacttcatcactaccaaagaagaaaaaaattagccaggtgtggtggtgtatgcctgtagtcccagatactccggtggctgaggtgagaggatagcttgagcccaggaaattgaggctgcagtgaactatgattgcactactgtgctccagcttgggcaacagagtgagatcttgtctccaaaagtccttgaaggattttaggnaagttgttaaaagtcttgaaacgatgtttgggggcatgttagggttcttgaatgtttaattcctctaataactgcttattcaagagaagcatttctgactgggtgcagggcag

SEQ ID NO: 38110 - DNA, 429 bp, Homo sapiens
gatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattct

SEQ ID NO: 38111 - DNA, 158 bp, Homo sapiens
gttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgtttc

SEQ ID NO: 38112 - DNA, 264 bp, Homo sapiens
  misc_feature 4, 10, 245: n = A,T,C or G
cagncacagnacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggantttgggaactgagctgtgc

SEQ ID NO: 38113 - DNA, 481 bp, Homo sapiens
  misc_feature 3, 22, 46: n = A,T,C or G
gancttctctgaagtctggganctcttaggttgggattctcaaccnttctgacattgctcaatcattgttgagtcctgctcaaaaccttagtgcattcagtttggaaacagaaggcagaactgattcagcatacaaggtaatccccatggagggcagttcactgggctcctcagctgggacattttactgaaaatgttgtttgtaaccagaaatgcaattagaatcaggtctagatcctttataagcagctctagcttcaaagtttatcctaaaaacctttacttacaagataagagagaggtttaaaattcttgtttgaatgctgggcatgggtagctcacgcctgtaatctgagcactttgggaggccaaggcgggtggatcatgtgatgtcaggagttcgggactagcctggccaacatggtgaaaccccgtctctactaaaaatacaaaaattatccaggcgtggtggcagatgcct

SEQ ID NO: 38114 - DNA, 261 bp, Homo sapiens
  misc_feature 6: n = A,T,C or G
tgcagnaatgacatagtggatgatgactaaagtagaagttagattactatgttttcctctaattgactctatggcaaagctctgaaaccatttttggtgtcagtatccaatttgtaacatgagacaattagaggatttctaaaatctcttttcactcaaaaattctatgcatctgagagttccacttccagtaaggctaagtaagttcctgacagactaaccatcctgcagaaacctattgtaaaccctggacaaaatact

SEQ ID NO: 38115 - DNA, 458 bp, Homo sapiens
  misc_feature 7: n = A,T,C or G
atagcangccagctttgaccttcaaagggtaacctgtccttgaaaagtttgactagaaatacccaccccctgccacaggaaaatggtaagaagcttgtccctacaggggctttgagtaggaaacaaattattctcccctgagaatttttaaccacaagcttgcatctaatatgggcttaggttcacatgtgtactaattgtgtagcttgggaatcctcaagcaggacaggttatctaattgcagggcccagtgcaagatgacaatgtagtctttaatttgacaattattaagaatttcaagacagtgacagcagagcattaaatcaagtttattaaacccatctaagcatgaggccccatgtgactgcacaggtcacatacccatgaagttgatcctgtctgtaagccacaaaattaatgtagaaatgggttcaggctgcatctgacagaaacaaaca

SEQ ID NO: 38116 - DNA, 212 bp, Homo sapiens
  misc_feature 209, 210: n = A,T,C or G
taaaagtgtcgcctgggccctgggggcaaagacagtagataacttctctgtcgtgttctccagaagggcccaacaattacaaggttctacggttctaaattccaatctagtcttccacatcattttgaaggtataatattacttgtcaaagtgggatgatagaagatatgtgtggacataaattgttgtcaaggaaaaaaactaaaatnnga

SEQ ID NO: 38117 - DNA, 275 bp, Homo sapiens
cgtggtggctcacacctgtaatcccagcactttgggaggccgaggcaggtggatcacaaaatcaagagatcaagaccatcctggctaacatggtgaaaccccgtctctactaaaaatacagaaaaaaattagccgggtatggtggcgggcaccttgtagtcccagccacttgggaggctgaggcaggagaatgacatggacccaggaagcagagcttgcagtgtgcagagatcacaccactgcactccagcctgggcaacagagcaagactctgt

SEQ ID NO: 38118 - DNA, 461 bp, Homo sapiens
  misc_feature 1, 19, 21: n = A,T,C or G
nagcagtacctggacgagnanattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccga

SEQ ID NO: 38119 - DNA, 462 bp, Homo sapiens
  misc_feature 12, 18: n = A,T,C or G
caatggaacagnaacagnaagcctcagaaataacaccacacatctaccaccatttgattttttgacaaagctgacaaaagcaagcattggggaaaggattccctatttaataagtggtcttgggaaaactggctagccatatgtagaaagctgaaactggatcccttccttataccttatacaaaaattaactcaagacagattcaagacttaaattttagacctaaaaccacaaaaaccctagaataaaaccttggcaataccattcaggacataggcatgggcaaagacttccaagactaaaacaccaaaagcagcggcaactaaagccaaaattgacaaatgggatctaattatactaaagagcttctgcacagcaaaagaaactgtcatcagagtgaacaggcaccctacagaatgggagaaaatttttgcaatctatccatctggcaaagggctaat

SEQ ID NO: 38120 - DNA, 242 bp, Homo sapiens
  misc_feature 5, 153, 216, 223, 242: n = A,T,C or G
aagangaaaatacaagtatgacagcagtgatttgcatttagtgactttggatgaagtaactgaagaggatgaagactctctggcggattttaacaaccttaaagaagagctcaattttgttactgttgatgaagttggagaggaggaagatgnagataatgatttaaaagttgagttagcacaaagcaaaaatgaccatcccacagattaaaaaangggattngaaagaagagagctggggn

SEQ ID NO: 38121 - DNA, 313 bp, Homo sapiens
  misc_feature 2, 10, 313: n = A,T,C or G
antctagaangaacaaaaacttatccccactcaaaagcatgtacgtgaatgttcttagcagtttattttataatggtcaatatctggaaacaatccaaatgtccttccatgagttaatggttaaaataactgtggtgcacccataccatggaatactgttcagcaataaaatggaatgaaatgacctgaatggatctcaggagaattatgctgcatgaaaaacacccatctcaggccgggtgtggtgcttgcagtgagctgagatggcgccactgcactccagcctgggcaacagagagagactccatcacan

SEQ ID NO: 38122 - DNA, 480 bp, Homo sapiens
aggctgggtggttcaagattgagtggccacatctcgttggcttctggtgagggcctcatgatgcatcataacatggcagataagtggaaggggaagttggcatgtgcagagaccaaacacgagaggcagcctcactttacagtccactctcatgataaataattcagtcctgtgagagtgagaatttacccctaaaaggcattaatcccccttaatgacctaatcacctcttaaagtcacaagctcccaacatagctacaatgaggaccatgcgtccacatgagttttggtggggacaaaccatagcaaagtccaatttatcaagtttttttcttgtgttgctcaagattttggtttcacccaacgagaacaaagacacaacataccagaatctctgggacacatttaaagcagtgtgtagagggaaatttatagcactaaatgcccacaagagaaagcaggaaagatcaaaaattgaca

SEQ ID NO: 38123 - DNA, 107 bp, Homo sapiens
aaggctgacgtgagagaatcgcttgaacccgggagttggaggttgcagtgagccgagattgcaccattgcactccagcttgggcaacaagagtgaaactcttgtctc

SEQ ID NO: 38124 - DNA, 303 bp, Homo sapiens
gaaccaggaagaaactgaaatcctgaacaattctatgagttctgaaattgaaccagtgaccaaaagcctaccaaccaggaaaagccctggatcagatggattcactgtcacattctatcagctgtataaggaagagctgctaccattcctacagaaaatattcaaaaaaattcaagaggagagacttctctccagctcattctgtgagtccagcatcatcctgataccaaaacctggcagagatacaacaaaaaacaaatcttcaggccaatatccttgatgaacatagatgcaaaaatcctt

SEQ ID NO: 38125 - DNA, 472 bp, Homo sapiens
caagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctc

SEQ ID NO: 38126 - DNA, 172 bp, Homo sapiens
attcctaacctcttctgctataatttaatatttttaaacacttaagttaatcacttggcactgcatgtatttttcaccataaagtctactttttacaaacaagtactcaaagaaaatgtattagacctgtcagtgaaatcatggagaaaccaaatagcactataaatttaag

SEQ ID NO: 38127 - DNA, 376 bp, Homo sapiens
gagacagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtg

SEQ ID NO: 38128 - DNA, 411 bp, Homo sapiens
  misc_feature 368, 381, 409: n = A,T,C or G
ctagaggccaaggcttaaacaggcatctctaccagccccactgtctctaaccactcctgggctaaggagtaacctccctcatctctaactgcccccacggggccagggccaccccagaacttttaactcttccaggacagggagcttcgggcccccactctgtctcctgcccccgggggcctgtggctaagtaaaccatacctaacctaccccagtgtggggtgtgggcctctgaatctaacccacacccagcgtaggggggagtctgagccggggagggctcccgagtctctgccttcagctcccaaagtgggggggggggccccctttcacgtgggacccactttcccatgctggatgggcagaanacattgcttattnggagacaaattaaaaacaaaaacaactntc

SEQ ID NO: 38129 - DNA, 386 bp, Homo sapiens
  misc_feature 11: n = A,T,C or G
catcatttttntctatgtagtattttgtttttccaaagttcttacaatttctgactccaagatggcaaaattgtaccattattcctatgttaaagttaatgccatgtctactatagcttggacagccattttgactcaactgtctaatctaaatgtcatttcaatcagaaaaccagccatcaactgtcaaaatggtaaaaacagttatgtgtgttttcaaagccagaagtgcaatcatgtggtgagacttcagggttttactgttgtccacagttctgagtcccaggactggtttccttactcggtattctcccatggaaaacttcatcggggaattatagggtaatatttttcaagacttggaatatgtctacagttacctttct

SEQ ID NO: 38130 - DNA, 197 bp, Homo sapiens
agcctggccaacatggtgaaaccccgtctctagtaaaaatacaaaacttagccaggcatggtggtgggcgcctgtaatcccagttactcgggaggctgaggcaggagaattgcttggacctgggaggtggaggttgcagtgagccgagattgtgccgctgacttcagcctgggtgacagagcaagactctgtctcac

SEQ ID NO: 38131 - DNA, 475 bp, Homo sapiens
  misc_feature 462: n = A,T,C or G
gtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatactcatctgaatatttaaattaatgtctcctattgtcttactattagaggaagaagtgttgggatttatggggttaagggtcttggagtattcacaattttttaaatttgaaattatggngtgtaatccattt

SEQ ID NO: 38132 - DNA, 470 bp, Homo sapiens
  misc_feature 20, 443: n = A,T,C or G
aaaagcaaacatttaatttngctttaattgccccttggcacgtactaatttccagtgagttggctgtagtttagactaaatggaatgttttcagacgtttgaaggataattcttactttgaaaacctaaagactcagcatctggcttaatctactctttagttatcttggcattcttcagtgccatacaaagttaacatgactttatgttttcaatgataaacccctaagtttgtcatagatgtttttaatgccacttttttcaaacgctatttaaaatgtttctcttttccaggatggagtctatcttgtaaaatgtcctcttcacacatggtagaatctcctgtgttgtttggatgaggaggctatatttctagcaaaattttaagccaaaatctaccagttatagtcactccagaaacatttagtgggggtcaactatanggtcaagtttctggagacttaaacatg

SEQ ID NO: 38133 - DNA, 448 bp, Homo sapiens
gtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaaccttatggaacag

SEQ ID NO: 38134 - DNA, 277 bp, Homo sapiens
  misc_feature 276, 277: n = A,T,C or G
ctggataaatgggcaaaactcggtgattgaataggaaggagtgaaggaaggaacaaggatagttcttcctcacggatgtcagaagctggtgttcagtagcaggcatgtatagacatcataagtttggttggcttcatttgtgtttcttccctttaaatgaagtgaggtggtcatcctgctagcaactgacagcctaattagctctttctcattcgccatcagtatatgagctgaggactgatctactcttgacttgtgctttgagtttccagtgcnn

SEQ ID NO: 38135 - DNA, 468 bp, Homo sapiens
gagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatatctggaggctgattttcctgttctctgttctccactggaaaggttgtttacgacaaacctccttgtcaaagtgtgtaaaaataaaggattgctccatcct

SEQ ID NO: 38136 - DNA, 144 bp, Homo sapiens
cgtggtggcgcgcacctgtaatcccagctactggggaggctgaggttggagaactgcttgaacctgggaggaagaggttgcagtgagccgagatggcgtcactgcgctccagcctgggtgacagagcgagactccgtctcaaca

SEQ ID NO: 38137 - DNA, 472 bp, Homo sapiens
aatagtgggatactacaacatgacactgacagtattaggcagatcattgagacatacaactaacaaaaacattcaggacttgaactcaacacttgactaaatgggcctaatagatatctacagaactctgcatccaaaaataacagaatataaattattctcatctgcacatagcacatactctaaagtcaaccacatgattggccacaaaacaaccctcagtaaatcaaaaaaaactgaaatcataccaaacatactcttagactacagtgcaataaacaatcaacactaagaaaattgcttacaactatgcaattacttggaattaaacaacctgctcctgaatgacttttgggtgaaccatgaaattaaggcaaacatcgagtaattctttgaaactaaactctagtatcccagagataccagaatctctgggacacagctaaagcagtggtaagagggaattttatag

SEQ ID NO: 38138 - DNA, 461 bp, Homo sapiens
  misc_feature 247: n = A,T,C or G
tcctgcaggtgaacctggacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatcnggcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctat

SEQ ID NO: 38139 - DNA, 170 bp, Homo sapiens
attaataatttgcttaaattgcttttggctctttttaatgttgatgtgaaaatttttattccggttaaagatggtgaattttatatgcattcaataattctcacaaaacattaaaggaagttttcaagaagtaaaaccacaagaatgtggagaactagataatgaattac

SEQ ID NO: 38140 - DNA, 468 bp, Homo sapiens
gtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgt

SEQ ID NO: 38141 - DNA, 241 bp, Homo sapiens
ctgaggcgggtggatcacctgagccggagttcgtgaccagcctggccaacatggtgaaaccccatctcttctaaaaaatacaaaaattagccgggcgtggtggtgcatgcctgtaatcccagctactcgagaggctgaggcaggagaatcacttgaacctgggaggtggaggttgcagagagccaagatttcgccactacacttcagcctgggtgacagggcgagactccatctcaaaaac

SEQ ID NO: 38142 - DNA, 341 bp, Homo sapiens
cgcattgaaaacattgatcacctgggtttctttatttatcgactgtgtcatgacaaggaaacttacaaactgcaacgcagaagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccct

SEQ ID NO: 38143 - DNA, 290 bp, Homo sapiens
  misc_feature 5, 18: n = A,T,C or G
cggangtcagggacaagnatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaagcggattgccagagaattggcagaagatgacagcatattaaagtgagtgaccctgcgacccactctttggaccagcagcggatgaataaagcttcctgtgttgtgtga

SEQ ID NO: 38144 - DNA, 460 bp, Homo sapiens
  misc_feature 15, 21: n = A,T,C or G
cataacacagcaagnacgagnaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaag

SEQ ID NO: 38145 - DNA, 457 bp, Homo sapiens
  misc_feature 457: n = A,T,C or G
tgagaaattctagcacatgatcttactgagagagagtggcaataaagcatttatagtcgtgtaccatagaaagatgtttaggtcagtaacagaccatatatatgatggtggtctcattagattatgatactatatttttactgtaccttttttatgtttagatacccaaatacttccgttctgttacagttgccttcagtattcagtacagtaacggtgcacagatttatagccttaggagcaataggctattataccatatagcctaggtgtctagtagactataccatgtaggtttgtgtaagtacactctatgatgttcacacaacaacaaaattgcctagcacgtctctcagaactgtatccttgtcattaagcacacgtgactatatttaaaaataatgtttccatttgacagtgtgtaaaactacattagttttgaattagttttatggan

SEQ ID NO: 38146 - DNA, 207 bp, Homo sapiens
aagaggagatgggaagcaaaatcagttgtatgaatccagttcccatgtttcttctaccatcctgcctctctattaatgggttaatagttcactgagggtggtggcttatgcctgtaatcccagcattttgagaggctgaggcgggagtattgcttgaggccagttcgagaccagcatgggcaacatagcgggatcctgtctctacag

SEQ ID NO: 38147 - DNA, 465 bp, Homo sapiens
agaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttgggaagagtcaagggtcacttttggacctatcaacagtgttgccttcca

SEQ ID NO: 38148 - DNA, 117 bp, Homo sapiens
ataagacagacagaatggactgtttgtggcaataagataccaaattataaacaggatctaaggtcatgccaagtaagggattgagttacacactccttgcacttaaagaataaactg

SEQ ID NO: 38149 - DNA, 340 bp, Homo sapiens
  misc_feature 261: n = A,T,C or G
caaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacataggtacagttggagcactatatgtactctctggactactttggacagaagtaggtttttgaatgtaacaagataagtcaacttgagttgtaatatatttnggggaatcagctcactacaaattgtgactgtaaacattgtactgtaaatgttttgtagttttcccccaataaaattttt

SEQ ID NO: 38150 - DNA, 487 bp, Homo sapiens
cagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccag

SEQ ID NO: 38151 - DNA, 487 bp, Homo sapiens
  misc_feature 5, 13: n = A,T,C or G
ctaancagcaagnagtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttc

SEQ ID NO: 38152 - DNA, 189 bp, Homo sapiens
  misc_feature 24: n = A,T,C or G
gtctcagaaaaacccccgttttanttatggcccgggaaacttccgtaaaagttacaaaaattggccgggcctggtggctcacgctgtaatcccagcattttgggaggctgaggtgggtggatcacctgaggtcaggagttcgagaccagcctggtcaacatggtgaagcctcatctctactaaaaatac

SEQ ID NO: 38153 - DNA, 160 bp, Homo sapiens
tctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttc

SEQ ID NO: 38154 - DNA, 377 bp, Homo sapiens
gatcacagagggttttcagggcagtgaaattactgtgtatgagtagtgaattcatgtcactatatgtttactcacactcatacaatgtacactaagagtggaccctaatgtcaactattcactttgggtaatagtgatgtgtcaatgtacgctcatcagttacagcaagtgtacttctctggtgggaattgttgataatgagagaaggctatgcacgtgagggagaaggaggtatatggaatatctccgcatctctctcagttttgctgtgcacctaaaactgctctaaaaagaaaacagtcttaaaagaatatgtactctctctgatattttttgtttagcgtgctctataaatgttaaattatgtctactgggct

SEQ ID NO: 38155 - DNA, 500 bp, Homo sapiens
  misc_feature 3, 7, 27, 28, 179, 452, 467: n = A,T,C or G
acngtcntataactgggcaccaatccnntgaagagctcaggtaattgaaaatggggctttccagggaatgaagaagctctcctacatccgcattgctgataccaatatcaccagcattcctcaaggtcttcctccttcccttacggaattacatcttgatggcaacaaaatcagcaganttgatgcagctagcctgaaaggactgaataatttggctaagttgggattgagtttcaacagcatctctgctgtcgacaatggctctctggccaacatgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttccttattcgggngtgagtccttttcangcaacccgggccaagtactggggagatacaagc

SEQ ID NO: 38156 - DNA, 259 bp, Homo sapiens
gaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcccgcattttgagttagtttatagtgctaatagattctatataactgtgagagtttggtagtaaaccagtagggattgttttctctcctaaaaaat

SEQ ID NO: 38157 - DNA, 106 bp, Homo sapiens
  misc_feature 82: n = A,T,C or G
attcgggaggctgagcagggagtattgcttgagcccaagaagttgaggctgcagtgagctatgatcacaccactgcactgangcctaagcaactgagaccctgtcg

SEQ ID NO: 38158 - DNA, 336 bp, Homo sapiens
attggtgagaatatggagcagccagaacctcttaaaacatacatagctgatggtaggactataacgtgtgagagttcttaactttggagaactgtttggcattaaagttaaatatacgcccactctatgacccagcaattctaagttttcatccaaaagaaatgaaaacatctctacaaaagctatacaagcctgatagtgtaaaactggaaacaaccaggtgtccatcgataggagaatggataaacaaagtgtggcaataacaaggaacaacccatgatacacacaacatggatgaactcaaaaacattgtactgcatgaaagaaatcagacac

SEQ ID NO: 38159 - DNA, 473 bp, Homo sapiens
ggagccttgtgcttaagtgattcagatactaaatttctattgggatggttggctgaaattgtccttttaagaaacaggttataaagatagctggcttaggtggacagtttattattttttggtgggttatgtattctgtatacaggaaggggttagtagtttgggagtcatgaaattaagtaatgttcaacccgtgttaacttgggagcagtggttagcaaacctgattatttgacagataaaaaatcttgggtcctattccagacttactaaattagaatcttttaggcatcaatcctaggaatttgtattttttaagttctgaatactttggatgtctggtgggcaactttttgggagttactgccttagaaaactatccagatagttgtgaccaaagacctatttgaaatgggtgtgagaaaggaatagcttaaacttgagaaggaaatgaggactactgtgcttttttt

SEQ ID NO: 38160 - DNA, 144 bp, Homo sapiens
  misc_feature 7: n = A,T,C or G
ctaccantttaaagttacggaatctaccattttaaagttaattgcttgtcaagctataaccacaaaaataatgaattgatgagaaatacaatgaagaggcaatgtccatctcaaaatactgcttttacaaaagcagaataaaag

SEQ ID NO: 38161 - DNA, 176 bp, Homo sapiens
cactgcccatatttgacaatttgatcccctgtctatgtggtatcttttgttaggtcttagtcaattttagcttttttccattttaacaacttcaaaaggcttagaattgtacctgaggtttccaccttgccagaatttctagtttagggcccactatttatctttttctttttatg

SEQ ID NO: 38162 - DNA, 140 bp, Homo sapiens
gtgtgccgtacgtgtatataactgaagtgtctgtacggaatgccctttgctagccatgggctggtcaccagattgttttgtaatgcccgccccttgcctcgatattgccagtttcttgtgcaataaacaatcagcagctg

SEQ ID NO: 38163 - DNA, 487 bp, Homo sapiens
gaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataggtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccct

SEQ ID NO: 38164 - DNA, 470 bp, Homo sapiens
  misc_feature 411, 441, 443, 451: n = A,T,C or G
ctccagtacactcagtaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattgggcaataaaggactctgggaaaaaactgggaactggcactacagcggnattcattaataaaaacttaggccaaaaagncngggacctntccctaccggaggactgct

SEQ ID NO: 38165 - DNA, 480 bp, Homo sapiens
  misc_feature 4: n = A,T,C or G
aacnagctacacgtacagctcatggagctgaggagctgcaagggttacaagcagtgtaacccccggactcgaaacatggacctgggacttaaagatggaggaagctatgagcaatacaggtatttcgttttattattaaagcctaaacaaagttctcctatcttggcccatccttcagtctcatctctgtgagtctgcacctgttatcttgagaaactgcccttccctctggtctgcccgagaccaggatcacccaccaaagataggtgtcacctaggagaccttctttgtatagttctttgggaactttttctttcttggtgatggttaacattcattctcctttgacacttgaaaacttaggcagtttcagcgtcgaaagtggccagaaatgaagagaccttcttccaaatcactgggacaactgtgggaaggctgggaaggttaagaaacaacagaggtggacctccaaaaacatag

SEQ ID NO: 38166 - DNA, 277 bp, Homo sapiens
  misc_feature 4, 18, 21: n = A,T,C or G
aganaaatatcatatcanatntacagtaaaatataccttggtgccaccaacccattttgtgccacatgcaaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgct

SEQ ID NO: 38167 - DNA, 327 bp, Homo sapiens
  misc_feature 200, 201, 206, 239, 245, 259, 299, 312, 314: n = A,T,C or G
gagaggcagcgtgcgggtgtgctctttgtgaaattccaccatggcgtaccgtggccagggtcagaaaagtgcagaaggttatggtgcagcccatcaacctcatcttcagatacttacaaaatagatcgcgggattcaggtgtggctctttgagcaagtgaatatgcggatagaaaggctggatcattggttttgaagaannttttnaaccttggtttaaatgatgccaaaaaaaattcntttttnaaacaaaagccaanaaaacccctggggggggggttttttcctaaaagggggaantttttttcttttncnccaaaaaggggcc

SEQ ID NO: 38168 - DNA, 475 bp, Homo sapiens
tgatgtcactgatagaacgaagctgagtttccaagggtttggggctgtgcaagagtaaacactagagcttgagttgttatccagctggcaagcacggaagtctttgaagaatgtaatgtaaaaagggaaaagaatgtaaagctttttgtaccaaatgagagttggagcccagccaacaaatgcttttccctgtgtaaaagtctctctggaagggacattccatctccatggtgcactctgaggggcactgtcaactagagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttgggggagagtcaccatggaatgttgacaattactt

SEQ ID NO: 38169 - DNA, 418 bp, Homo sapiens
tgtccaaatgtcctgagctccccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaagga

SEQ ID NO: 38170 - DNA, 493 bp, Homo sapiens
  misc_feature 7, 13: n = A,T,C or G
aaagtanaacacntagaactagaagatgaactcaaagaaggtggaggattttgtgaatcttaattatcttttttatctctaatgcctagaataatgtctgatataatgtaggcattcaataaatattcgatgaataagtcaacactaggagtgtattttgaatgtcattgttgaatgaaaaaatacccatatttctgatatctcaggaagtagaaaactcaagtgcttgtttctatagattagaatttaggaaacttgaaaattatcatgttgcaaaataatttctaaacttttgttggaatttaatttttgtcatctaaggccaaatgcctgcctgggtcagtgtacaaagtcatagtcctatctatgaatgggttcaaaatttcataaaaaccacagttctaagtcaggaccagcacctttatttgttttctgctcctgaaatgctgtcatgaatatcgatgcactatacttccaaagtaaactagatttt

SEQ ID NO: 38171 - DNA, 350 bp, Homo sapiens
cttggctaaggagttagagcaaatgccttcctactaagccgatcacttcaaaacaggcaaaatttataatagagtcaaatcaggactgaatgcatcaacaaaaactggagttcagcttatcaaatacagatcaaaagcaagaaatagactagagagcacacgggatatttcttccttaaatttctctattttttattgacactggaggaaaaaatagcacattaaaacctccttgctgaattactgtcctaaaccaatagatccgtggggcttgttcagctaaaagccacaacagactatgtaatgcaatgatgtaatcttggcatcttggctttgtgtcatttatattc

SEQ ID NO: 38172 - DNA, 402 bp, Homo sapiens
tggtttaaaatatttctgttctattttctaatttgttgccggaggtcttgggttttctatttgagtgcttgcaaactcaatgtgatttctgtcagcatatcttaggtttgtttgttatgaaacttacgcagtgtgaggttctatctgaaaatgttatttagctatcttctgggactatttaatgaaagtggggtcatgaatccttaaaattcttgtgcagctttgagaaacatttctgttatttgggtatcaagtttgtaagtgtggtaaagccaagatggaaactagcactttgcttttttggttgttgttactggtctaacctgcttgaactagtctgctgtcctgtcaaatgcatctttttatttacatgtcccttaaattaaagctgatcatgaaagt

SEQ ID NO: 38173 - DNA, 482 bp, Homo sapiens
  misc_feature 11: n = A,T,C or G
aacttttgatnctgactttcgtttgaaccaaaaaaataaaaagaggaaagagccacgtaaaaggaaatacagcttgatttcatttttttcttgttttatttgatgaactaaattgtccattcttcaggggctcagaatagatatttccttttgttttgtatcaaatattaaagagagtttgaccttctttgcaggtcagaaaattaattagttaactctggatattgaatatgccacaaagtagactaaaatacttcagatcatttctagaatgaggcaaggcctaaagaaataaatcctctaaatcgagtgaggttggccaaagatacctagcattttatggttggctgaagatacccagcattttattaactctttatgacttctttatcacgagatttgagtcacctgctactaagacacataaatagattggtttgggtcaacacacaacatgtggattaaagtataacctttcagag

SEQ ID NO: 38174 - DNA, 354 bp, Homo sapiens
gacatattttgattctttcgtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaaac

SEQ ID NO: 38175 - DNA, 225 bp, Homo sapiens
  misc_feature 8: n = A,T,C or G
aaatcctnttctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcc

SEQ ID NO: 38176 - DNA, 468 bp, Homo sapiens
agctgttaaaaacagcagtgctgtattgtagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatgggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgga

SEQ ID NO: 38177 - DNA, 366 bp, Homo sapiens
  misc_feature 362: n = A,T,C or G
gagttgagtagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataanaagc

SEQ ID NO: 38178 - DNA, 395 bp, Homo sapiens
ccgttttcctgccgtggggacaatatcgagactaaaattcggctagggaagacatcttactcctaactgttaaaagcaaacttcccgttcccaaaagaggcctagagcctgatttctactaggcggcttagaaataccatgtgcttgccagggaaaacagagagagaaacatttattgagttactgcctgccgtgattcacgatcttttctgacagacctgttttccctgaactgtaaagattcctgcacattgaacacccagagagagggtaagagaccaccaatagaaagtttggtgacagggtagcttggaagaaagtcttgagattaaaggacagatttgaagttgagatccgctccatactcaccagtctgatgattgaattttcctttt

SEQ ID NO: 38179 - DNA, 480 bp, Homo sapiens
gaaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacga

SEQ ID NO: 38180 - DNA, 492 bp, Homo sapiens
  misc_feature 4, 5, 24, 34, 437: n = A,T,C or G
aacnntagtcaaatcccaacctcntactaaagantgtttttggaaagcacttgatgtccctctctgggctgacagtctactgactgtctaaatgagactcagaaatctgaaagcttggttttcattagctccaaactatcagttcctaaaaaggcttagaggacattggaagacaaaagtggctatcctttgctaggaattatcaggaataagtacctaaattaatctctccaggatttttttgttttctcttcagcatatgcccaaggtatgtattgatgtgagcagcctgaagctattctgaatgacaaggactagttttaggtaacctccaattgaattgttttttatttttcctatggagatccagagacgttttgttttcaaatggagcaaacagcactgtgatactgactttgtttattaaaaataaattnggttccaaattaatttcaactcataatgagttaaagcgattagaaataaaagata

SEQ ID NO: 38181 - DNA, 459 bp, Homo sapiens
  misc_feature 29: n = A,T,C or G
gactgtgacatgaacactgcacttgaagnagcctgaccagcgctgggctcagtagaactatcctttcttctcccatggtgtatcctcactgtccaggactctcttctcagaagcccactccttcccctgtactgtttatatgcttaatgaaaccaagtacccaaagtgaccgtttaactgttactaggcagctaagtagactccattaaaccttttccttccttcctccccttctttctttctctcccattcttctttcattcttctcgtccttccttctatcctttcttccttcctgcctccttttcttcctctcctctgccctttctttcaggtcttttttgtggtaggaactggtaagaaaaggaaaggaattccctaagattttaaggaaacaacaacaaaaaccaggttatgtttggtgagagagttggggcaagaaactgcatcttctaatat

SEQ ID NO: 38182 - DNA, 472 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttacacagcttaaagtttagtttaaaagttgtaggtgattaaaataattttgaaggcgatcttttaaaaggagattaaaccgaaggt

SEQ ID NO: 38183 - DNA, 176 bp, Homo sapiens
  misc_feature 151, 162: n = A,T,C or G
gctttccggcggtgacgacctacgcacacgagtaacatgcctctcgcaaaggatctccttcatccctctccagaagaggagaagaggaaacacaagaagaaacgcctggtgcagagccccaattttcccttactttcatggggatggtggnaaaaaattggnccccccaaggggga

SEQ ID NO: 38184 - DNA, 344 bp, Homo sapiens
gtacaacataaagtaagttgcttgttgtttgagaagtttaaccccgttgcttgttctgcagccctgtctacttgggcacccccaccacctgttagctgtggttgtgcactgtcttttgtagctctggactggaggggtagatggggagtcaattacccatcacataaatatgaaacatttatcatgaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactc

SEQ ID NO: 38185 - DNA, 346 bp, Homo sapiens
gtaatatattaacagtaattaataaaatataacagttataacaatatactttaataatagttatatgaatgtggtctctctctcaaaatacctcactgtactataccacggctaactgaaaccacagaaagttaaaaccatagataagggggaactattgtgtgcttcagtcactcctgagggcttcactgtggaaacacagtgtaagataataccatttttcaacaactacagaattaatggatttaagcattgatcatcaaaggatgcaaatactataaaaagagacaaatatgtgcctcataatggaagaatacaacctcacctatgaattatttttgctacc

SEQ ID NO: 38186 - DNA, 201 bp, Homo sapiens
  misc_feature 125, 197, 198, 199: n = A,T,C or G
tcaaggcagaggcaggaaactaactggtgtgagtcaaatgccccctgagtgactgcccccagcccaggccagaagacctcccttcaggtgccgggcgcaggaactgtgtgtgtcctacacaatgntgctattctgtgtcaaacacctctgtattttttaaaacatcaattgatattaaaaatgaaaagattattggnnngt

SEQ ID NO: 38187 - DNA, 500 bp, Homo sapiens
  misc_feature 9, 17, 241: n = A,T,C or G
acggaaacncccgtctnttatggcccgggatggtagttaaaggatacttcattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagncagatactaatattctgtagaagatatttctaaaatcttatctttaaaatatgaaataatttttaattggggtggcaaccttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattaggttttt

SEQ ID NO: 38188 - DNA, 231 bp, Homo sapiens
  misc_feature 35, 43, 106, 153, 174, 193, 206, 222: n = A,T,C or G
atgggccggggtaagaggcccaaagcttgctgttnatttaccncacttgccagaacgactgattcactgagttaaaacttggcattgctaagtcattcttacctancttttaaaatgacagattcttatgacctctttgagagcagagatatncctaagtctgctagcttggcnttgtagatactcttgttanagagaaatgtttncatcattaatagtatnaaagagcca

SEQ ID NO: 38189 - DNA, 311 bp, Homo sapiens
  misc_feature 292: n = A,T,C or G
caacagtaacctttgttattgaactgctccgatagccttgatttatttttactaaatacagccccaaaagttaataacaaggtagacacaaaagcattttgcagtactttattgaaaaatgtcggtggtatctcctagtaatcaaacctacacctttcaagaatcacggtttaattacaagactcatgaacataaaaaaataataccctcggcttatttcctgtgcacacactcacaaggagctgtgaatgaggtatagctgagtgcgtggagaggcgggcacatccctttnctaccattccagccccctt

SEQ ID NO: 38190 - DNA, 473 bp, Homo sapiens
cacgattgtgtcatattaaaatataaaaagagaaaaaaatatcctgaataaaaatagatcaagctgtacatatatatagattataagtgcaaaatactgagtgtggttaaagcctatgctatgcttgctgggtttcctgtacagaagtaggcattggagacagttttgctcttgtggtacaacatggatgactagaggcaggtccaggatgttacttttactgccagccgtcgcttccctccaaatagactattggaaggggaacctcccgccaaacgctgcctactgctatagtgttgggataagttgcaagcttaggaagatgagatgacatgatttaggaacttcaggatgaagtgaagtatctcctgccttgtgactgactggatctgcatcgtatcagatacctcctcaaggcaggaattttaacctgctgttataagacctggttctatatatgggatagcccaggt

SEQ ID NO: 38191 - DNA, 303 bp, Homo sapiens
atggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttg

SEQ ID NO: 38192 - DNA, 131 bp, Homo sapiens
gaaaaaggaactgttcagcaggctgatgaataagatctaagagttacctggctacagaaagaagatgccagatgacacttaagacctacttgtgatatttaaatgatgcaataaaagacctattgatttgc

SEQ ID NO: 38193 - DNA, 343 bp, Homo sapiens
  misc_feature 10: n = A,T,C or G
gagttcaagnaccagcctaggcaacatggggagacctcatctctacaaaatatcaaaaaattagccaggcatggtggcatgcacctgtagtccagctactctggaggctgaggcaggagtatcacttgagcccaggaggttgaggctgcagtgagctgtggtagcgccactgcactccagcctgggcaatagagtgagagcctgtctcaaaaaaaaataagtaaacaaagataagtaaaaagtaaaagttctccatttactcagcaccttattctccgcataagtacgtatctttcagatgaaagcatagatgtgcaataaacacatagatatcagaacttta

SEQ ID NO: 38194 - DNA, 460 bp, Homo sapiens
  misc_feature 12: n = A,T,C or G
gtgtgtagaatnaaaacctacaggaaagcaaataatggcacatgaagcctggtagtggaggggttggagggtggtggggaaagggaccaatgtcttagagcattggcccaagaaggattgcagtggggtatatgagcaagtgctctggcagtatagatgctgctggtctgagtgggatatttggaattgaaatgtcccagcttctgagtttctgatgatgccaaggtccagggtgagaccatgggaatggaagactgaggcagaatgcatgtcctgtttttagaactaagagtccagggtgttaagatttgtcgtacaggtacaagttcaagtcagatagtgctggagtgaacaaagactatgggaaaggaactaagctgtttagggcagagtgaccaggacgttagtaaacgaaagcaaacaggagaggaagatagtgggatagccctctgtctgacca

SEQ ID NO: 38195 - DNA, 485 bp, Homo sapiens
cagctatggtgagattctttcctggacctcttccgccttcacctcaattagctgggcatgggcagctaattcattcttgcactttctccatattattgcttctctcctaggttttttattgtggttttgtttttgttttttgttctttgacttggtacttccactgttctggaagaatgcaagcagaaatatcaaagaggaacaaataagaaagaattactggggaaaagtgatgcctttataagagtaaaacgttattcttcactataaagtataataagagggaaattttcttcttttacttgttagaattataaagatagttatatatgtacttttttcaaaaatcaagctgtgcgtgttggctcgtgcctataatcctagcactttgggaggccaaggagggtgtgtcacttgaggtcgggggttcaagaccagcctggccaatgtggcaaaaccccgtctctactagggatacaaaaatt

SEQ ID NO: 38196 - DNA, 226 bp, Homo sapiens
  misc_feature 219, 220: n = A,T,C or G
gaggtattgaggcagccagcgcaggggcttctgctgagggggcaggcggagcttgaggaaaccgcagataagtttttttctctttgaaagatagagattaatacaactacttaaaaaaatatagtcaataggttactaagatattgcttagcgttaagtttttaacgtaattttaatagcttaagattttaagagaaaatttgaagacttagaagagtnncctggg

SEQ ID NO: 38197 - DNA, 487 bp, Homo sapiens
caggaagcaagcgtctgccgcggtggccgggtgccgatttgacaagatcaaagctacaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctcttt

SEQ ID NO: 38198 - DNA, 462 bp, Homo sapiens
  misc_feature 12: n = A,T,C or G
gagtattaaagnattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaagactaaggtacagagaagctcggtaaattgcccaaggctatacagtaagtggcagagccaggattcaaatccaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttattttgaagaatggaggcattatccgggagaaccaaacggaaaggagagggatattc

SEQ ID NO: 38199 - DNA, 429 bp, Homo sapiens
  misc_feature 21, 23: n = A,T,C or G
agtgattgggggagaacaagnanaggacttttgagttttaggtatctgtatgtatgtactttcttgacctctgttatatttctccagataagtactgtttaaataacatataaagatgtcagatgagcaatagatagataagaatggtgcaaaaaaaaatcaaaatatgaagctactgagagcaatttctgagtctcagcatactgagttttggccccaaagtgcctggggaaaatggacatatcatctaaaaagctgtaaataccagccaacaacaggaagtcttagactcctgtcccacacttctgagctgcagggtgtggggggaagccccatgcctttatctcactgtctctatctctagcaaggaaacctgtttcctgactctgcagaatttcgctttccccctttttccttaaaagcagagtt

SEQ ID NO: 38200 - DNA, 158 bp, Homo sapiens; identical to SEQ ID NO: 30320

SEQ ID NO: 38201 - DNA, 475 bp, Homo sapiens
  misc_feature 162, 445, 471: n = A,T,C or G
atccaatttcaatggccgtttttactatctgatccaccccaccaaactgacctatgatgaagcggtgcaagcttgtctcaatgatggtgctcagattgcaaaagtgggccagatatttgctgcctggaaaattctcggatatgaccgctgtgatgcgggctnggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgtttttttttttccaatatgaactcatgcaagttaccaaaactgtgataacccttttttacttactgtaaagagtcattttcataaanatcaattcattgatttggttttttgnaaag

SEQ ID NO: 38202 - DNA, 205 bp, Homo sapiens
atctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgttc

SEQ ID NO: 38203 - DNA, 481 bp, Homo sapiens
ggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggattggaaggcttgacacttcaggactacagtgaacattgtaaacacaatgaatcagtggtaaaagagatgttgggaattagccaagaattaca

SEQ ID NO: 38204 - DNA, 354 bp, Homo sapiens
  misc_feature 350, 351: n = A,T,C or G
gagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggagggaagaagaggagacttcnnatg

SEQ ID NO: 38205 - DNA, 417 bp, Homo sapiens
gcatgcccgtattcattgcagcactattcacagtagccaagatatgggaataacttaagtgtccatcaatatatgaatggatttaaaaatgtggtatatatacacaatggaatacattctgccttaaaaaagaggaaattctgtcatttttgacaacgtggatgaacctagaggatgtaatgttgaagtcagttacagaacgacaaatatcatataatctcacatgtagaatctaaacaaagtctaacttatagagaagtagagagtagaatggtgataaccagaggctgggaggggaggggtgagtatagaaaaaagggatacattggtcaacaggtagaaacttatagttagataggagggagtagttcctgggtgttctattgcagagcatgttgactgtagttaataataatg

SEQ ID NO: 38206 - DNA, 338 bp, Homo sapiens
  misc_feature 19: n = A,T,C or G
cgaccaaggccttcccggngtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgctccctctgtctcctctttctccctggcctgtggttgtcccccagcctctgccaccctccacctcctcggtcagccccagccccaggttgataaatctattgattgattgtgata

SEQ ID NO: 38207 - DNA, 455 bp, Homo sapiens
  misc_feature 17: n = A,T,C or G
aaggatggatccccaancctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagcctggaagttctgtttggagcccatttctgtgagaccctgtatttcaaatttgcagctgaaaggtgcttgtacctctgatttcaccccagagttggagttctgctcaaggaacgtgtgtaaatgtgtacattctgtgtccatgtgtgaccatgtgtctgtgaggcagggaacatgtattctctgcatgcatgtatgtaaggtgcctggggagtgtgtgtgggtccttggctcttggcctttccccttgcaggggttgtgcaggtgtgaataaagagaat

SEQ ID NO: 38208 - DNA, 347 bp, Homo sapiens
  misc_feature 6, 31: n = A,T,C or G
gggcgnagcggcggattagccttcgcggggnaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctgg

SEQ ID NO: 38209 - DNA, 403 bp, Homo sapiens
gtttacaaatgatatgctcttatatttggaaaaacttaaatactccacagaaaactattagaactgataaattcaatgaagttgcaggatacaaaatcaatgtacaaaaatcagtaacatttgtatataccaacaatgaacaatatgaaaaataaatttaaaaataatcctatttacaatagccacacataaaattaaatagctaggaattaatcaaagaagtgaaagatctctataatgaaaactgtaagacatcaatgaaagaaattcatgaggacaccaaaaaaatggaaaaatattccatattaatggattggaagaatcaatattattaaaatgttcatactaccgaaagcagtctatagattccatgcaattcctatcaaaataccaatgacattct

SEQ ID NO: 38210 - DNA, 298 bp, Homo sapiens
ggattatgcataaaatacttgtgtgttttgaatctgttttctattctgatcacttaactttcccatttgtttatggatactttggaagtgggatggtggatctgtagaaagaaataaaactgagtgtagtttcagacctaacttggtgactatgtccaatgctaaccaagggaaacttgttttgtatctagaaatctaccaaaggagggatattatttgccctcattgagaaggatggtaagggacactaagattgaatttcagagtcctttgaaaatttttgtttgactgttattat

SEQ ID NO: 38211 - DNA, 250 bp, Homo sapiens
attataataaagggtttttatttgatttatcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgc

SEQ ID NO: 38212 - DNA, 233 bp, Homo sapiens
  misc_feature 1: n = A,T,C or G
natgacaggcattgttgaaataactttagatgtatcatagtaaacatgacaaaaacctgatgacaaactatttctctccatctatggcaacaaaagtggcccatagagagtttgcttcagatcagaaagctagtggttccagtgctagagagggaaagatcatacacttaattgacacacttatttatggcatactatgtgccagtaactactcaaactgctggagatcattg

SEQ ID NO: 38213 - DNA, 241 bp, Homo sapiens
  misc_feature 3, 45, 75: n = A,T,C or G
ggntcatctctggggcagggcccaggaatctacatttttaactanctccgtggcatttctcaggcagatgctcanggaatcacactttgagaagtgtctagagagaatttcagtacaacagacttaccacatttccagctgaggtctaaaagagagagggaaagcagaaccaaaccaatcatactgtactccagcctgggtgacagagagagactgtctcaaaataaataaataaataaac

SEQ ID NO: 38214 - DNA, 396 bp, Homo sapiens
agtgaagcctggctgcacagctcacaccgtgtctgcagcttcagggagtgagcccctggttacgtggccattctaactgggaggatcttgtactctttccttcccagggacttttgggaactttttggaaactctagggtgtcagccagatcctgagggagtggagaggtcttgagtgacttagcaggacataaagtcttagttacttgactcaagacccctctcccttcagacgggtttgatgtttgatgtgctttcctatcttttaagaaacttgtccctcactcttcccgccagctcaaacttcctgacaagcattcagctaacgccccacatatatatcacgtgacggtcctcctctgaaatgtcaggcccccagcccaattctgaaggcac

SEQ ID NO: 38215 - DNA, 399 bp, Homo sapiens
  misc_feature 6, 27, 32: n = A,T,C or G
gtaacnaaaagcaacaaaccccagggnaaggnggaaacatgattttcaaaattgtgatattagattcaaatgtccgattttcaagaaaaagaatcacaaggcatacaaagaaacaggaaagtatggcccatttaaagaaaaaaagtcaatagaaactgttcctaaaaagacctgattgattatatatctactagacaaagactttaaaacaactgtcttaaagatgctcaaaggactaaaggaagtgtcaagaaagtcaacaaaaaaatgaatgaccaaaattgaaatattcataaaaagatataaaacctaaaaagaaaccaaaaagaaattctgaaggtgaaaagtataatcatggaaatgaaaattcactagagggattaaaaagcagatttgagc

SEQ ID NO: 38216 - DNA, 157 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctc

SEQ ID NO: 38217 - DNA, 318 bp, Homo sapiens
atattccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgagg

SEQ ID NO: 38218 - DNA, 361 bp, Homo sapiens
  misc_feature 25: n = A,T,C or G
attggaaacaaactaaatgcccacncagaggagaaggtttgaataaactgtgttacatccatatagccatataatggagtaccatgcagataaatcagaaactagagattggttacctgtagggagtgggagggagaagaagggagtggagatctgtgtagcatggatgaaatgtgagtggcacttctcagagtatatttgtcagtataactctgattcttagaaccataggaatgttttaaatgcttctatgcaattgccaccaaccaggatgtgggagaccaaataagcaattaccacctacccagatgcaggagaacccaaaaaggaatagtaaaattcacataaaagaggataggga

SEQ ID NO: 38219 - DNA, 160 bp, Homo sapiens
  misc_feature 6: n = A,T,C or G
cagatngcagtgattcttacttctagtaactgtaaacatttgctttcctcatgatgatgctttttgatgttagaaagaaaaacaacacctttcaaaaagtttggttatgagcaatgtcagaattttgctgtaaaggaaaggatctctaacaggccaattc

SEQ ID NO: 38220 - DNA, 344 bp, Homo sapiens
gcgacccaaatgtttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgaatgttttcaaaagttatgtttatatttacatgtgtgtgaactaccattttctgtatacccttgctgataactattaagaatcttggtctggcatggtg

SEQ ID NO: 38221 - DNA, 217 bp, Homo sapiens
  misc_feature 10: n = A,T,C or G
caaactaagnccgattttccggaaaaggcttaaactacaaagaagattgtgctaaggcttgagcgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgtac

SEQ ID NO: 38222 - DNA, 118 bp, Homo sapiens
  misc_feature 30, 111: n = A,T,C or G
ctcccctcttctgggaaagtggtgaatccnacccaaaaataactgcctctcgctcctcaacccctcccctccatccctggccccctccctggatgacattaaagaagggtngagctgg

SEQ ID NO: 38223 - DNA, 470 bp, Homo sapiens
  misc_feature 7: n = A,T,C or G
acagaangttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggggcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattag

SEQ ID NO: 38224 - DNA, 477 bp, Homo sapiens
ataacactagggtcatcttactaccggaaaatttaacaaaatgttaaactccaagccctatcttagaaaaaatattaaagttggaagataaagaaaatgcctgcagacctctagggaaaagatcaaataacttacaaggggaaaagattattatcacctgtctcagaaacaacatacaaggcaaggcaataatggaggagcattttcaaaagcctaagaattgcatacccagtcaaaccattcttcaagtattattgctataaaaaaacttttagacattcaagagatcaaagatagacattcaagagatcaaataattttatactcattatcccatcttaaagaatctactataagatgaacttcaatcaattaagaaaaatgacagataatgagtaaagatttgttggaatgagaccaaaatgaaggtgcagtcaagggtgaaatgttatacaacacatgctataagttacatat

SEQ ID NO: 38225 - DNA, 407 bp, Homo sapiens
cttccggccctgtgcgcctttctcatcagcttcttccgaggtgacaggtgaaagccccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgc

SEQ ID NO: 38226 - DNA, 480 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccacc

SEQ ID NO: 38227 - DNA, 410 bp, Homo sapiens
  misc_feature 32: n = A,T,C or G
gaaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttta

SEQ ID NO: 38228 - DNA, 316 bp, Homo sapiens
  misc_feature 10, 12: n = A,T,C or G
cacccagggnanttcggttcttacggccgggagggaagccggtgtgatggctcacacctgtaattccagcacttttggaggctgtgacaggaggatcacttgagcccaggagttgagtccagcctgggtaacatagcaagacctcatctctacaaaacattgttaaaaattagctgggtgtagtggcacatgcctattgtcccagctatttggaaggctaaagtgggaggattgcttgagcctgggaggtcaaagctacagtgagccgtgattgtgccactgcactgcaacctgggcgacagagagatcctgcctc

SEQ ID NO: 38229 - DNA, 377 bp, Homo sapiens
ggaggccttgtttttaagaaaaacatgtcatgttggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaaagaatcaaaggttctgattttgagttgcaataaagggaaagaccatgctcatagcagtgccaacatctgaagtgtggagccttacccatttcatcacctacaacggaagtagttaacctggaagagattaccaagagaataaaaagagactcattcagtggaagc

SEQ ID NO: 38230 - DNA, 421 bp, Homo sapiens
  misc_feature 7, 159, 388, 391, 406: n = A,T,C or G
caaaaancacatttccgcattgtggaacatggtgagacactatataaaattccagaaagaaagcaactggatttacagatttattgtgagacacaaattcactgctgcctttacactaagaaatgtatatgttaaccatatatgctgtatttattttgncgttaagcatactttcagtttactcagaattttcaatttgctataaagatgtgtcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaatttaaagtctatgttttcagttatgactcangtnaagaaatgtgttttnaggatctacttgctg

SEQ ID NO: 38231 - DNA, 370 bp, Homo sapiens
agttgatttagctataaaaatactcagtgataaataagaatggtttcatgatacaactatgtttggtttaagaaaaacaagtacttgttcctattcgaagagacaacagctgaaatgaaaaagatttgacaaagaaagcatagtaatggaatgatttcttaaactgacgtgtagacaagcaggtagataaaaatctctgtcttgtcttcagcatggtattttagacagatcaatgaactgaaggtgtgaacagagtggaatgaatacagtagtcctctcttatccaaggtttcactttctatagtttcagttacccaggctcaacccatgtcattgtgttgtatcaacagtgcagtaagatattttgaga

SEQ ID NO: 38232 - DNA, 446 bp, Homo sapiens
  misc_feature 19: n = A,T,C or G
aagaagcatccatcgcagnagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacagac

SEQ ID NO: 38233 - DNA, 124 bp, Homo sapiens
tggaagaacctgtttgatgcaaaaaagaaaatgaaaaacaaaacaaaaaatccccaaaaccttattatgggagcccgtcggtcttagaagctgtttgacatgtataatgaatggcattgactgg

SEQ ID NO: 38234 - DNA, 467 bp, Homo sapiens
  misc_feature 7, 33, 39: n = A,T,C or G
agagtgngaagtagtagctgtttttgaaacaantagatnagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaagtgattaggaaacactggcttttttttgtttttctgtgtaataacgtaatgaaggcaattttcctatcagagcaaattgccagattttaaaaattccagttttactcttaaatttctataaaaccacaagatgttttaatatttcaataacttctaagaaatacttcaaaattg

SEQ ID NO: 38235 - DNA, 266 bp, Homo sapiens
  misc_feature 262: n = A,T,C or G
gtgcccagatgagattttcaaggacttttcttgctgtccttgagaggtaactgttaggaagtgtctggccggcgatcgctgcgactgaaacccctttcttttccctttaccctggatggtctcccctttccttacctaagccagatttcctttcctcacacttgaatccagagttcacactggagaaaagggttggagaagtcagaggaaacctttgacaaatgccttggggtgaggggtgagtaggaggatggagaagctnaaga

SEQ ID NO: 38236 - DNA, 453 bp, Homo sapiens
gaatttacattttagtatattgaataagagatgtataaataaatgcattaagttcagttagtgctaagtgctacaaagaaagtaaaataggataatgtgatgagcagtgattggggaagagaacaatatgaagtaggataaccaggcagtgcctctctcaggagatagcatatggactgagacctgaataaaaagtagaaagtggtgatgattaaagatcagagaaatagcattccaagaagagggaatagcaaagccaaagtcattgaggcaggaataagtttactgtgttcctgcaacataaagtccggtttggccagaaagagatgagataatggggagcaggcagaaaattaggttagataaggaagcaggaagcagaagtaggacttcacaggtaatgagaaagtgtaggtctatttttaagttcattgagaattcattgaagagtac

SEQ ID NO: 38237 - DNA, 376 bp, Homo sapiens
  misc_feature 7, 19, 111, 241, 268, 297, 318, 344, 353, 361: n = A,T,C or G
ggagatngaatggagtganaggaatcaagaggaatttaagtaggaaaaatggaaaggacttgatgggttacgatgtggggatgagggagacagaggggttaaagctgctanatttttgtctccctcaacttaagggatggtagggccatcacttttctgtgcatcccaaggatcttgtgaatatcaatgaaaaaatggccatgaaaatattttgcatagcgtaatattctatacatatgtnaattgttataaagacaagcctaagcanactcagaaagaattggagaaaggaaggcnagaatgtgttttcttttttgncagattgttttcacttagggattcanctgaaaganggctgggnaatgaatacttgact

SEQ ID NO: 38238 - DNA, 471 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggagggaagaagaggagacttcaaatgaaggaggaaacaatgaagaatcgaatgaagatgaagactctgaggctgagaataccacactttctgctacaacactgggctatggagaggacgccacgcctggcacagggtataca

SEQ ID NO: 38239 - DNA, 345 bp, Homo sapiens
  misc_feature 25: n = A,T,C or G
atgatgtatgaccatgcgacagaancccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagct

SEQ ID NO: 38240 - DNA, 422 bp, Homo sapiens
cacctgaagtaagtagtattctttggaactggaggtgctgtatgatggatcacttgagtgatttcctcagtctttttcacataatcataaatattatctggtaaacttggttccttgagattttgtcagatgtagtgagttcacctggcacttatttggcaccataaaccacgctggactagagactgagatatccttacatagtggtccatggacatggccccttcctggcactgccaggcatttggaaactattactttccttgagtatatttgcctcctcagctggggtttctcgtctgaaatcacagaacatagaaaatgatttgagggactcttctggagggcacctgacttttctctatacatatttcttgaatgatactaggtaatttattacatacaagagatgcctaaggaat

SEQ ID NO: 38241 - DNA, 464 bp, Homo sapiens
  misc_feature 31: n = A,T,C or G
gaaggatggctgcacgaaacataccggtaantggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttccttgtaagaccttcgggtcaaggcagaggcaggaaactaactggtgtgagtcaaatgccccctgagtgactgccccca

SEQ ID NO: 38242 - DNA, 490 bp, Homo sapiens
  misc_feature 7: n = A,T,C or G
atggatntcatcagcattgacaagacgggagtataatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgct

SEQ ID NO: 38243 - DNA, 480 bp, Homo sapiens
  misc_feature 29: n = A,T,C or G
gacaaccttagccaacctttacccaaatnaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccac

SEQ ID NO: 38244 - DNA, 158 bp, Homo sapiens
  misc_feature 32: n = A,T,C or G
gactcttagcggtggatcactcggctcgtgcntcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 38245 - DNA, 413 bp, Homo sapiens
  misc_feature 33: n = A,T,C or G
acataaagtgaggagaaggggaaggaatattcntctacatttcagagatattaatagaatcctaggagataaaaagaaaatttaaaaactagtatataaaacagaatggagttttacttctagcaatagctcctattggaccaatcttcctgtagatagcatttataactctcaacaaactatgtaaaatgactatctgaaggtactacagtctaaagcatgcagaaatgggaagggaattgatactgagtgaatttcccatttttacagcttttcacttgaagggatgacatatttcgtactagctgggtcaactagaacttggataaaaatctgtggtcttattatcttgaagaatgagaggacagttctacatgaattagagttcagggttaccacagcagctggaagat

SEQ ID NO: 38246 - DNA, 465 bp, Homo sapiens
  misc_feature 30: n = A,T,C or G
atattgttagaaccaaaaatcttgaacctnaaaatgtttaagtaaattgaccctgcagctaggtaggccattgtaccctataactcatacacctaagaccccactaagtcgccccacccagggaggcaagaacatacctcatcggagaaggggggaggtcctagatgattccctgacatctcttccaattaggatgtattttccaggttactcatgaaggcagcagttcctacagcatgattatggtaggattataaagttttgcaactgaaagggatcatgaaaagtatagcctagcccccattttcaggtgtggatagtggagctcaagagaggtttgatggcctacagagtcatacagctggattcagtgtgacttagagacagacagctctgtcatctagatccttctggatccttctagatccttcctgtggctgatggtacacacagatcaccggaggt

SEQ ID NO: 38247 - DNA, 161 bp, Homo sapiens
  misc_feature 6: n = A,T,C or G
gaaggncacaggtaaaaatagaggttgctaaaacttctttccagctttattgaggtataattgacaagaaaaaattgtttttatttaaggtgtacaatgtcataatttaatgtacacaaataaattaaaaataaacctttaaagcatccaggcacaacaac

SEQ ID NO: 38248 - DNA, 420 bp, Homo sapiens
aattaaagtaatattctgactaatgtttagttgaattttggataaagctcaaaataagcattggattcccgtagctttgggtttctaaaccctggaagtaatgaatgtgacaaatgtgagacaggatattagagttaatagtgggtaatcattccattatttgtgatccactgcacatctgctacactgtacatgttagatgctacagtgacacagagctatggatcttgcctcaaaaaagcttatggatgagtagctaaggtcagcagataatggtgacaatgcagaatagaaaggggtcagaggccgagtatggtggctcgtgcctgtaatcccagcgcttcgggaggccagggtgaaaggagtgcttgagcccaggggttcaagtccagcctggacaacatggtaagacgcatctct

SEQ ID NO: 38249 - DNA, 149 bp, Homo sapiens
caaattaatagtcctgagcaagcaagaaaaagaggtaataacatacccatttctttatgaatataagcttataatattttttcatgtgctatttttactgagcaaattgtatgtctcacatgttaacacaataaatatcttgacaattt

SEQ ID NO: 38250 - DNA, 278 bp, Homo sapiens
  misc_feature 32: n = A,T,C or G
ggtagaacttgaaaagactattgtgttgtaanaaagaaccccaaagcagcatgaaaaaaattagaaaagttggttttcctcttttcacctttgagcattgtgcctgcaatcaagcatgtgtacaaaactgtctaaagccatggtttacctagggcctattagttaaggatgctattgaaaaaacacctgtaatacatcaattgacgttcacatttggagattaggtaaccaaattacaaactataaattcatgtttccactctcaatgttgaagactg

SEQ ID NO: 38251 - DNA, 314 bp, Homo sapiens
gaaggggatcaagggacggctgaacagactttccgctgctggtgtgggtgacatggtgatggccacagtcaagaaaggcgaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 38252 - DNA, 136 bp, Homo sapiens
  misc_feature 58: n = A,T,C or G
agctgacaagattactgcacttcttggagacttagtaaactcatctgtagtacatgcnaggagacaagaatgtacacatgagagaatggtggtcaaagatgatacaagcttaatagtgacaagtgttctgctatgg

SEQ ID NO: 38253 - DNA, 128 bp, Homo sapiens
  misc_feature 12, 18: n = A,T,C or G
accagtcaaggncaaggncagcatctgtggttaaaaatatagcattctgacctaaaaaagttattttgcagatgaatgtgttttcaactcaggacctatccaaatgaggaatttttaaatattctttt

SEQ ID NO: 38254 - DNA, 288 bp, Homo sapiens
atttcctgttagtctaaagtttgaaaggatagtactcatttaaatgtatatattatattctgcatatataggaggttatagaacactaggcggatttaacctaaagaagactacctcaaggtatttaataatcaaactcacaaatatcagggataaagaaaggatctcaaaagcagcaagagaaaagaaacaaataacatgcaatggacctcaatacatctggcagcagacttttcagtggaagccttacgggccagaagagagtggcatgacatattgaaagtgctg

SEQ ID NO: 38255 - DNA, 337 bp, Homo sapiens
aaatctcttctttacagtacaatactacctaataaatgcaggaggagccaggcacgatggttcatgactgtaatcccagcaattcgggaggttgagagatgggagaatcgcttgagcctaggagtttgagactagcctgggcaatatagtgagaccttgtctctacaaaataaatttttaaaaattagctgagtgtggtggcatgcgcctgtaatcccagctacttgggaggctgaggtggcaggatcccttgagcccggggggtcaagcctgcagtaagccaagattgcaacactgtactccagcctgggcgacagagcaagaccgtgtctcagac

SEQ ID NO: 38256 - DNA, 490 bp, Homo sapiens
  misc_feature 9, 20, 30, 40, 45, 46, 47, 48, 51, 53, 54, 55, 60, 68, 74,79, 90, 98, 120, 153, 191, 223, 233: n = A,T,C or G
actttacangttgatataantatgtctctnaattgtaggnctgannnntgntnnntctancaaggtcncttatnacttnttaatgtttangataattnggcgatagtagactaaaaattngcaggtggaaatttctgttcatgtcctgtgatngctagaggtttataaagcaaaaactttaaaacttaganagaaccatgttatggctttgagtcaaagactncggacagtgntttgcacctgaaaaagaaacagaatctagactcatgaggagttaggtaagttcacaggaattagcagacaggaattccaagagcagcacagacctttccgtactaatgtttcaagccaacccacatattgcagttgctgagccacacctagacttgcagcggaaatgtaaagacaagaaagatatttggcttctaacttcccctgagtctgtttcagtttccttttttgcaaacctttatcaacagttgttcataag

SEQ ID NO: 38257 - DNA, 251 bp, Homo sapiens
  misc_feature 7, 9: n = A,T,C or G
ctctcangnaaaacatcatctggtccaacctcatgtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttt

SEQ ID NO: 38258 - DNA, 349 bp, Homo sapiens
  misc_feature 15, 22: n = A,T,C or G
cagaacgaatctagnatagagnactttacactcctgacaaaacttactcaaaaatggatcacagacctaaatgtaaaacaaaactaaaacaaaaaaaaacttagtatataatattggggaaatctagatgactttgggtttgactataccctcctagttacaatagcaaaagcataatcaatgaaagaaagaataatttggatatcattaaaataaaaaaatctgtgctgggaaatacattgtcaagagaatgaaaagacaagcaacagactgggagaaaatatttgtaaaagatatatctggtaaaagacagttatttaaaatataaaaagaacttttaaaattcaac

SEQ ID NO: 38259 - DNA, 346 bp, Homo sapiens
  misc_feature 7: n = A,T,C or G
agggaancctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 38260 - DNA, 341 bp, Homo sapiens
  misc_feature 35, 60, 209: n = A,T,C or G
acaattcccgataattagcattgtcagactataancctttgctttttaaagtttattttnactatttctttatcactttattgtatcatcaccattggtttcataatgtaaatactatatgttgaacaaattaaatgtcaaaattttttattaccatagtccatgttaatagtggggctttcaggtgtttagagattttttttgttgtngtgaacattcattgcaaaagtactagatggtgtataactctagagttgaattttaagggattccctaatatgtatactatctttttatctgaagtaataaataaacaatgatcttgaaagtgcctgaatcac

SEQ ID NO: 38261 - DNA, 464 bp, Homo sapiens
  misc_feature 7, 22, 34: n = A,T,C or G
gcattgncattgcacccatggnacataggagggnccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaaca

SEQ ID NO: 38262 - DNA, 412 bp, Homo sapiens
  misc_feature 33: n = A,T,C or G
ggagcgagcatcccccaaagttcacaatgtggncgaggactttgattgcacattgttgtttttttaatagtcattccaaatatgagatgcgttgttacaggaagtcccttgtcatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcaca

SEQ ID NO: 38263 - DNA, 381 bp, Homo sapiens
  misc_feature 7, 32: n = A,T,C or G
gacacanggcctggttacctgtcatggaatgntgcagtggtggtttgccaagcttctgtggatgtttgaagactttatttttgcagtcttaaccttgggctggacctaagtgtatgtaaaccatatgatgtctgtattgtttatagatgctgacaaaagaaaactagaccttttgttttttgttgtaagatttttgttttcatgcctatgctcatagtagatagtttgcaaatgaaagttgatttgccatacttttaaataatattgttttagcttgaatattctataatacacttttatagagtataacatgctaaatcactgttttgttgtaagaaaggtgtaaacattttgttaataaaatgctatgtttacgaatac

SEQ ID NO: 38264 - DNA, 468 bp, Homo sapiens
aagatacccaaggaaggtacaagtgaaagatttttaaggatttaatattttaaggatagtaaagcatactccaaaaatgaaggccacagaaaactattaagaacatgcaagagctcaggaaatactgttcccataccccttctcaagcaatgtgctagagaacaagctccagacaaccaaaatgataagacaccaagtactttgagaggcaagagtgaagcaggagtctagagtaaattagagaattgattcaaagtccacataaagtgttataccagttctgaaaaccagacaactaccccaactcagcaatacgttaattttgtgaagtaattaaaccaaagagatcacaaatttaagggcaccaaccaggctcactggttggtgagagaaaagaagtgcaaaaccacaaatagttgagatttggcaaaagtccatgtactgaatggcgagacttcaaatcctttc

SEQ ID NO: 38265 - DNA, 172 bp, Homo sapiens
  misc_feature 15, 33: n = A,T,C or G
aataacagaaacttnaaagttaatgggatggtnggatctcacaggctgagaactcgttcacctccaagcatttcatgaaaaagctgcttcttattaatcatacaaactctcaccatgatgtgaagagtttcacaaatccttcaaaataaaaagtaatgacttagaaactgcc

SEQ ID NO: 38266 - DNA, 490 bp, Homo sapiens
gatctcctttaagaattaacgaaagcagtgtttagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctg

SEQ ID NO: 38267 - DNA, 495 bp, Homo sapiens
  misc_feature 22: n = A,T,C or G
ctttgcaagaaggtagagatanagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagaattttggcatcaagaactaacaaagaaatcagagacatt

SEQ ID NO: 38268 - DNA, 361 bp, Homo sapiens
  misc_feature 34, 35: n = A,T,C or G
catcccggtatggaagctgctggaagtcccattnnggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaagg

SEQ ID NO: 38269 - DNA, 366 bp, Homo sapiens
  misc_feature 32, 348: n = A,T,C or G
cacaatcttatctaatagccgttcttgaaacntttgaaagaaagcccgaggaagttacatcagaaggcacatgagtggcaccagccaaggagaaacaaaaaaatccttcccgacacaagctacaaaaccaaaattatcccaagaaagactgcccaccgctttattagtcccaattgcattttcgagacctcatgatccaggccctatgtccattttaatattttccttagtaggtctttgggttagggggaaattagattatccatggggcctaaactggcatgctagagcttccagtgtgtgtgtgtgtgtgtgtgtgtgtgtgtgtgtctatgtgtgtgtatgtgnacacacgcacacatatac

SEQ ID NO: 38270 - DNA, 120 bp, Homo sapiens
ggaactgaggcctctgtagcagctgcagaaatgtttttgcttattttgagcattctaagtttttcctagccatgaataacaacaatcgaataaatcatcccacagtgtgtaggatggttg

SEQ ID NO: 38271 - DNA, 365 bp, Homo sapiens
tgcacattgttgtttttttaatagtcttccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcaca

SEQ ID NO: 38272 - DNA, 168 bp, Homo sapiens
  misc_feature 13, 23, 27, 167: n = A,T,C or G
aagtatttgaagnactgaaaagnaaanttagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaant

SEQ ID NO: 38273 - DNA, 439 bp, Homo sapiens
  misc_feature 32: n = A,T,C or G
agtctccttcaaataaatgaactcaatctaanttaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaattttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgc

SEQ ID NO: 38274 - DNA, 191 bp, Homo sapiens
  misc_feature 23, 41, 60, 96, 111, 146: n = A,T,C or G
aatgctatattttaaaaacaccngttgttcatttaactggnagaatgtcagtccaatctncaatgagaacatgagcaaatagacctttccaggtgngaaagtgaaacgtantgggtttctgtaagtgtttcctgatggcttcatcnctatctttactttctctggaatatgctacacaaagggctttatta

SEQ ID NO: 38275 - DNA, 236 bp, Homo sapiens
  misc_feature 24, 142: n = A,T,C or G
tagttaatctgccattatattccncaaagcacagataaaataacttctattttataagctgaccacagtgaatatgctataaattattcaatattttgtataatattaaacactgtgctaaataagaaggtatgtatacatngcacacacacagttctgtacatattagtgcactattattagccgtttcggttccaaaggattaagtatctacctggcttcccgtattttagaac

SEQ ID NO: 38276 - DNA, 299 bp, Homo sapiens
ctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaa

SEQ ID NO: 38277 - DNA, 435 bp, Homo sapiens
aaagggatttaaagagtttttcttgggtgtttgtcaaacttttattccctgtctgtgtgcagaggggattcaacttcaatttttctgcagtggctctgagtccagccccttacttaaagatctggaaagcatgaagactgggctttttttcctatgtctcttgggaactgcagctgaatcccgacaaatgcaagattattatctgatcattccaaaccaactgctgaaacggtagcacccgacaacactgcaatccccagtttaagggctgaagatgaagaaaatgaaaaagaaacagcagtgtccacagaagacgattcccaccataaggctgaaaaatcatcagtactaaagtcaaaagaggaaagccatgaacagtcagcagaacagggcaagagttctagccaagagctgggattgaaggatcaagaggac

SEQ ID NO: 38278 - DNA, 214 bp, Homo sapiens
  misc_feature 51, 179: n = A,T,C or G
attgtaccatatgtttgatttttttttattatttcataagaaaactacgtnaattttaccttactttcattgtaaataagcctgtcttcctatctggatttttttgtgtgcatacatattctactgattaactacttttgcagttttaatcctgtattatttcttctactttgttttgngtaaaaggggaaaaaataaaaaaagctggaatctc

SEQ ID NO: 38279 - DNA, 220 bp, Homo sapiens
  misc_feature 25: n = A,T,C or G
gaaattcttggaccggcgcaagacngaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagctttccgggaaaccaaagtctttgggttccggggggagtatggttg

SEQ ID NO: 38280 - DNA, 483 bp, Homo sapiens
  misc_feature 32, 33, 35: n = A,T,C or G
ataccacctcccactgctttctgaagatgctnntnggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcgacttcgggctcgctggagaacaactaaggggcaccaaaccctctgaggttttacctttaaggttcgctgtatgtttgccttggacaaaaaggctaccaaccacgtgctatccagtaatatacttaaataagccaatacttagatctactgtaaggcagatgctaattat

SEQ ID NO: 38281 - DNA, 435 bp, Homo sapiens
  misc_feature 3: n = A,T,C or G
ctncaacctagatttttgaggtttatagtgcttttctccaaatgtcattatcatccctaaagtgaaaaaaaaaggtttaattattatgagcagtgaaattaccatataatcttccaattaactgaataaggcaccaaataagtgccctcaagccttaatttccaccttgaagttaaggtaggtatcatgcttaccttgatcatcctacacatcctcaaagtgggcagagttgaaaggctgtctaagcgggtgggatgggaggcggtgcccttccaccctcctgtctgtttgtcgagctctgttggtccttccgattggttagcgaccctgagtgtttctgagagccttttgttgtatgtgagggcagaaccactaatctggccaattccaagcagaaaagatcaagtatagatttcatatctgagttttaagtgc

SEQ ID NO: 38282 - DNA, 449 bp, Homo sapiens
agtgtccatcagcaccaacagcacagttctttttatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaacac

SEQ ID NO: 38283 - DNA, 381 bp, Homo sapiens
  misc_feature 25: n = A,T,C or G
accttcaaagatcattataatttanaaacctattaggatgaattattgggctatatcctgcatcacaaaaccaatttggaaactcaatttaatgagcttagaggtcaatatttgctaaattaattggaagatattgtattttcccttttttgagctgtgtagacacagcccttttggctggaacacactttgttacttatataccaatgaactgaattctgatgaggtcatgttttgacgtaggatggggacaaatagtaaactttcgtaaggatcttggaagatacctgaaaagactcagccaacggagatgaggattgactgcatgaagtgcattggagagaacagaagtttctgctgctaaaaaccattaatatatta

SEQ ID NO: 38284 - DNA, 357 bp, Homo sapiens
  misc_feature 271, 298, 311, 325, 340: n = A,T,C or G
cgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtatatatatatatatgcacagntatctaagttaatttaaaggtgtgtgngcctttttatttntgtttttaatgctnagatatttcaatgtnagcctcaatttctgaac

SEQ ID NO: 38285 - DNA, 420 bp, Homo sapiens
  misc_feature 19, 413: n = A,T,C or G
atctggtgttaagatttgnagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggnagtgaga

SEQ ID NO: 38286 - DNA, 239 bp, Homo sapiens
  misc_feature 7, 235, 236, 238: n = A,T,C or G
caatttncctttttaatgaacatgtgaagttattctgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaanntnc

SEQ ID NO: 38287 - DNA, 469 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatagagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaaccgaaggggattaaaagaccttgaaatccatgacgca

SEQ ID NO: 38288 - DNA, 104 bp, Homo sapiens
ctgcccctcaggtgggacccaggcgttctcagctgtaccctctgccgatggcatttgtgtttttgatatttgtgtctgttactacttttttaatacaaaaagat

SEQ ID NO: 38289 - DNA, 265 bp, Homo sapiens
  misc_feature 56: n = A,T,C or G
aatttctttgtgtctgttttcttaattgtatatgggactcgcgtaattccctctgnacttctgatgagaattagtgatttaatacttgatacgctcaataaatgttgcttgtcattattttctattaaactatattgttggatttttgagaatgcatgaagaaacttaacgttaattgtgttttgatttttaaaggcgttatgtaaattttgttttgtgcttttctccaggcaagaaaccggtttgaatgtaattttcatgaaat

SEQ ID NO: 38290 - DNA, 498 bp, Homo sapiens
  misc_feature 24, 25, 395, 485: n = A,T,C or G
gaaacgaggctgatccgtgacctnntcacttcaggggctgggggagtacatggaggcccattatacctatctgtctactttggtattattgggcatttaaaattttcctcaaaagatttttttaatctaaaaataagtttaatatagcctaaaataatgttttcagtattgtcgatcattatgtaaaagtaaaacttcactgcacctcagcaaaatacaaattctcagaataacattccaagacccaactagacgtcattttgtacttgactactaagaaaataagctacttttggccgggcgctgtggctcgcgcctgtaatcccagcactttcggaggctgagacgggcggatcatgaggtcaggagatggagaccatcttggctaacaccgngaaaccccgtctctaccaaaaatacaaaaaaatagccgggcgtggtggcaggcgcctgtagtcccagctacttctgggaggctgaggcanggagaatggcgtg

SEQ ID NO: 38291 - DNA, 368 bp, Homo sapiens
  misc_feature 250: n = A,T,C or G
ctcccaggttcacgccattctcctgcctcagcctcccgagtagctgggactacaggcacccgccaccatgcccagctaattttttgtattttgtttagtagagacggggtttcacagtgttagccaggatgatctcgatctcctgacctcatgatccacctgtctcggtctcccaaagtgctgggattacaagcgtgagccaccgcgcccggccaccttattaaatcttaatagcatacttggtcatggngacacatgtttaggttgctttgtgttctttcgatttctgattattaaagagtaatgaaatagctattaaaaaggagaaaatatgttcatgaattctaaattgtaaaagtggattggac

SEQ ID NO: 38292 - DNA, 371 bp, Homo sapiens
  misc_feature 34: n = A,T,C or G
atcacaccataaaattttacaagtgatagggctntttaagatcatctaatccaaccctataatttatgaaagtagtaaataagactgaagaaggacaaaatgacttaaactacacatggaacaatttaacagaaatatttaaaacttaactcttttgttacactacttcagtatgcttgtttagaggttatacaagccagttgtttttattctctcaagtaatttaaagactgtcacttgagactcattttattttagtcaaagtagaaaagttaactccccaaatgctagcacttagtgcattaatttgtggatgattcatctcaaaattaccttcccatgtatctgctgcaattaactttgacaagtgt

SEQ ID NO: 38293 - DNA, 366 bp, Homo sapiens
  misc_feature 24: n = A,T,C or G
gtagtaagttgtagaaggctcgangggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatact

SEQ ID NO: 38294 - DNA, 148 bp, Homo sapiens
actttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 38295 - DNA, 102 bp, Homo sapiens
  misc_feature 20, 81, 85, 97: n = A,T,C or G
atgtgtatgagaccaagagntgccctcaggtatgggagatgaatatggatcagctccttttggaggctgatctctggaggnactnaggccgcaaagnaccta

SEQ ID NO: 38296 - DNA, 196 bp, Homo sapiens
gttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatggaaga

SEQ ID NO: 38297 - DNA, 258 bp, Homo sapiens
agggttcccgacctcgatgttggatcaggacttccgatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgaat

SEQ ID NO: 38298 - DNA, 310 bp, Homo sapiens
  misc_feature 25, 308: n = A,T,C or G
tatccactatgattataaactgtgnctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccgttttgtaaagagaataatattcaaagacttttgtagcatacaaagtgaaaacttgtatctgcgaaactatacttgtattaaatgtgctttttaaataaaagctcgtaacacanct

SEQ ID NO: 38299 - DNA, 500 bp, Homo sapiens
  misc_feature 178, 392, 462: n = A,T,C or G
ctaactgatctttgaatcagtcccttttgagaacctgctttttccaaatagcatcatgagcgtggtggtctggttttcctcttctatcttgttgtcatagataagatgcacatgaagaattcatataaattgctctcagatactatggattcctagcatattggattaaaaaagaagnggatatggtccttcgatagaatgtgaagtgtttttttaaaaatcagccaagaactatgcctgtctttttttcacacctgtgattctttcagcaagttagaaggatagcaagagaatgtgcatccttccccaaaccccgaagacaggcagctttggcttaaatatgcttatttattttcaaaattagaaaataaacacattaatgtaaatatgtngagacagacaaagaaatttgtctgctacttaataaacacgcgatttatactttttggcttctaattaatnggcgaccctgaataagggggacaactaaggcatattat

SEQ ID NO: 38300 - DNA, 178 bp, Homo sapiens
  misc_feature 120, 122, 132, 161: n = A,T,C or G
atcggaagagaagggatactcccggactagaaagaagtcacaaatcttcaaaaggtggtagtagtagagatacaaaaggatcaaaggataagaattcccgggccgacagaaagaggtctntntcagagagtngtcgatcaggccaaagatcttcaagaagngaaagaacccggaaatc

SEQ ID NO: 38301 - DNA, 294 bp, Homo sapiens
  misc_feature 23, 290: n = A,T,C or G
gtaaaaaatttaacacccatagnaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcntgct

SEQ ID NO: 38302 - DNA, 301 bp, Homo sapiens
  misc_feature 23: n = A,T,C or G
tcttggactgaagggattcctgncagttgggattttcagtttcaaaactggaagagtcctgggcaagctgggaggagttgggtcaccctactccactagctgtgggagagagctattgaatgccccatcttctgcttgtaattatttcatctggcttggaaaccatttgactggccagctgttgagctcctgctgtatgccagggcactgtcctaggtgccttatgtcccgaatttcttggaatccccacagtccctctgtgagtacacaccaccctatttccttgattctaagagtcact

SEQ ID NO: 38303 - DNA, 353 bp, Homo sapiens
  misc_feature 22, 24: n = A,T,C or G
gcgtgtggaatgtgtgtgtgtncncaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatg

SEQ ID NO: 38304 - DNA, 375 bp, Homo sapiens
tggattgtagccttgacgaggtccgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcaga

SEQ ID NO: 38305 - DNA, 216 bp, Homo sapiens
attaaaattgaatcagtggcaacccttaaagttttataaaatcatgctttgttagaaaaagaattacagctttgcaatataactaattgttttgcataattctgaatgtaatagatatgaataatcagcctgtgtttttaatgaacttatttgtattttcccaatcattttctctagtgtaatgtttgctgggataataaaaaaaattcaaatctt

SEQ ID NO: 38306 - DNA, 455 bp, Homo sapiens
  misc_feature 24, 445, 449: n = A,T,C or G
tacgcggggctaccggatcggtcngaaatggcagaggtggaggagacactgaagcgactgcagagccagaagggagtgcagggaatcatcgtcgtgaacacagaaggcattcccatcaagagcaccatggacaacccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcaggggactagcacatggcagtcgcttggaacccactcacaccaatccagtgaccgngtgngggctg

SEQ ID NO: 38307 - DNA, 288 bp, Homo sapiens
  misc_feature 31: n = A,T,C or G
gaggccctgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagacgaagcttcttcatggagc

SEQ ID NO: 38308 - DNA, 192 bp, Homo sapiens
  misc_feature 21: n = A,T,C or G
tgcctcagattgctgtccccngggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcg

SEQ ID NO: 38309 - DNA, 490 bp, Homo sapiens
  misc_feature 25, 476: n = A,T,C or G
tctcacagtcctggaggctgagacntgcaagatcaaggtgccggcagtcttggtgtctggtgaaggcctgctttctcatagaggcttccttcttgctgtgtcttcgcatggtgagaggaacaaacaagctcccttgtgcctttaataaggtgctaatcccagtcatgagggcagagtctcccgtaaggcttaacctcctaataccatcaccttgagggttaggattttaacacatgaacattgatggaacacaacgttcactccatagcaccagggtagtctcctcatgtcaaggtctttacctgaatcacatgcatgatgtaccgttttcatgtaaggttctaggaatctgtggacatctttggggggccattattttgccaatcacatattacatatattttaatatcctagactagtatgaaaacaatgccacttttcattgctttatatatgcatatatatatacacattgnctaatgctataatt

SEQ ID NO: 38310 - DNA, 499 bp, Homo sapiens
  misc_feature 429, 496, 498: n = A,T,C or G
cagttcctctgaaggtaaagagacgcacaagaaaaagaagaagaaagaaaagcataagaaaaggaagaaagaaaagaaaaagaagaaaaaacggaagcacagatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggnggcaggactgggaaaatctctgaggcgtgtcttccaggcccctcccacagcttgtgccctccacagngng

SEQ ID NO: 38311 - DNA, 443 bp, Homo sapiens
  misc_feature 23: n = A,T,C or G
tggtgaggcccgtgtggctactnctgtggaagcagtgctgtagttactggaagataaaagggaaagcgagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactgtacagaaacagtgtgtaccattccgacgttacaatg

SEQ ID NO: 38312 - DNA, 162 bp, Homo sapiens
  misc_feature 21, 26, 67, 75, 88, 89, 93, 110, 111: n = A,T,C or G
gtgcgcgcgcacgcacgcctngagcngtcagcattgcacctgctatggagaagggtattcctttatnaaaatctncctcatttggatnngctntcaggtggttttcaatnngctcactggccagagacattgatggcagttcttatctgcatcactaatcag

SEQ ID NO: 38313 - DNA, 108 bp, Homo sapiens
  misc_feature 26: n = A,T,C or G
atgaattttatattccgtgaatgtanattgtcttgtaatgttgcataatgttcactttttatagtgtgtcctttattctaaacagtaaagtggttttatttctatcac

SEQ ID NO: 38314 - DNA, 338 bp, Homo sapiens
  misc_feature 30: n = A,T,C or G
aaattataaccaagcataatataccaaggnctaacccctataccttctgcgtaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagccggttgtccaagatagaatcttagttcaactttaaatttgcccacagaaccctctaaatccccttgtaaatttaactgttagtccaaagaggaacagctctttggacactaggaaaaaaccttg

SEQ ID NO: 38315 - DNA, 131 bp, Homo sapiens
  misc_feature 30, 57: n = A,T,C or G
accccctacctcttatggccaagtctttgnttgtgttcatttaccaagttgacccanccttgtcttttaggttaagtaagactcgagagtaaaggcaaggaggggggccagcctctgaatgcggccacgga

SEQ ID NO: 38316 - DNA, 251 bp, Homo sapiens
  misc_feature 24, 245: n = A,T,C or G
gttaggactgagttttatgtgatngaattttggccaatggaatgattatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggngatgag

SEQ ID NO: 38317 - DNA, 457 bp, Homo sapiens
  misc_feature 6, 30, 32: n = A,T,C or G
aggacngtgcgtcacccgtcaaccagagcntncctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattat

SEQ ID NO: 38318 - DNA, 496 bp, Homo sapiens
agaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgaccctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctggcaacaggtcttacagggctgcttgaaccctcataggcctaggctttggtctaaaag

SEQ ID NO: 38319 - DNA, 356 bp, Homo sapiens
  misc_feature 332, 336: n = A,T,C or G
atcgcttgagatctccagccctaccgcggctcgaaatggaccccaactgctcctgcaccactggtgtctcctgcgcctgcaccggctcctgcaagtgcaaagagtgcaaatgcacctcctgcaagaagagctgctgctcctgctgccccgtgggctgtgccaaagtgtgcccacgggtgtgtctgcaaagggacgttggagaactgcagctgctgtgcctgatgtgggaacagctcttctcccagatgttaatagaacaagctgcacaacctggattttttttcaatacgatactgagccatttgctgcatttctttttatgttaaatatgngagngacaataaaacaattttgac

SEQ ID NO: 38320 - DNA, 233 bp, Homo sapiens
  misc_feature 24: n = A,T,C or G
aaagcaggcagatcacttcagccnaggagttcaagaccagcctgggcaacatagcggaaccccatctctacaaaaaatacaaaaatgttgggtgtggtggtgagggcttgtagtcccagctccttgggaagtcaaggtggaaggattgcttgagcccaggaagttgaggctgcagtgagccatgattgcaccactgcattccagcctgggtgacagagcaagaccctgtctcg

SEQ ID NO: 38321 - DNA, 319 bp, Homo sapiens
acctcccgcctgcccatcatcgacgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaacctta

SEQ ID NO: 38322 - DNA, 500 bp, Homo sapiens
  misc_feature 24, 112, 181: n = A,T,C or G
tgttttttgaattagaaatacaanagagatctaagaacttataaaatagttggtttatcaagcctaaaaagacataaatctaatttagtaatttaaatgtgaaaattactangatttttaaagattactttatagtgacatatccccttctatgtaaactctgtttcacattattttctgnaaaagcagaataagaattcaccaaatttgttataacaactccctacaaagaatgctgctgatctcccagcatgtgagatgttgtgggagctgagttgggaaaggagagcaaagccgcctccttccactcttctagagacacagaatgtagaatgctgccctgagttccgacctgcagcagcataagccacctccaccctatcccagtgatctgtccctgtgtgctcttcttctggctgccttagggtgttcttcagccagtttcaatgtcatgtcctcaaggaaaacttccctgacagacccccccttacgcaacacag

SEQ ID NO: 38323 - DNA, 490 bp, Homo sapiens
  misc_feature 6, 31, 32, 33, 100, 484: n = A,T,C or G
agcacncggttaaaatgccccttttttattnnntatccttacgaagcaagagtattgagttattaaaattaatatcctgatatttggggggaaatacttnaaacaatttctctagagtaactttctgaagtaagttttccaacttctagtgaaatcattaactggttctaaatctattggatctcaaactggtttccaccactgtgaacagaatggactgtagaagcagacctatgtataggtgggaatttagcatacgaagagagtacagatgcatttaaaaccatacggaaaggacaggttattatgtaagtcgtgttgggaaaactgcctgttcaacaacagaagaaacctcaacaagaaaacgtgggtgaatatttttataattgtgcagtaagtgaagatcctttgaagcaagacataaccagagccataaggaaaggtgttttacatttgatacatcaaagttcaatttatggcaggnggacac

SEQ ID NO: 38324 - DNA, 109 bp, Homo sapiens
  misc_feature 23, 24: n = A,T,C or G
taaaggcatttttgattaatgannccttcaatttatgatgtgtttattggaacataacctcaatataagttgaaaagcatatgtattttcaattctggcatgaacctat

SEQ ID NO: 38325 - DNA, 500 bp, Homo sapiens
  misc_feature 425, 496: n = A,T,C or G
acggaggttaggatgctacttgccgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgncttttaatccttcattgtttcatgtatgaagtttttaatcaccccctaacccccaaaaaagattcgggtgncaag

SEQ ID NO: 38326 - DNA, 500 bp, Homo sapiens
  misc_feature 478: n = A,T,C or G
acccaacttgccttcatgcgcctccctggccaactatgcctctcagcaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgngggcaaaagagaaaaagaagga

SEQ ID NO: 38327 - DNA, 239 bp, Homo sapiens
  misc_feature 29, 30: n = A,T,C or G
accctaaaatatttttacactcaacctgnncggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgc

SEQ ID NO: 38328 - DNA, 116 bp, Homo sapiens
gaggtcccactgcagtttcagaaaggtggaattttatatagtcattgtttatttcatggaaactgaagttctgctgagggctgagcagcactggcattgaaaaatataataatcat

SEQ ID NO: 38329 - DNA, 242 bp, Homo sapiens
gctccaggggaggaggagtcaggtgaggatgatgtggtgggcagggcgtcaagggagaaacctcagcaagcatcaggtaggtatgacacgcctgctcccagttcattgcatctatttttagtctctgctaacctcctgagaagtccacattctctttctagacttggtctgccgctgctcctggcctaatttgagcaactctcctttgctactgaatataagatgtgtggagggacccacat

SEQ ID NO: 38330 - DNA, 487 bp, Homo sapiens
ctcccgcaagaaccctgctcgcacctgcttagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggat

SEQ ID NO: 38331 - DNA, 312 bp, Homo sapiens
aacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 38332 - DNA, 109 bp, Homo sapiens
gacttacttttcttccgatacagggggatacctgcctgtttttcaaagtgtttatttactgctgttactatttgattagaatgtattaaataaaaaaaacctgatttct

SEQ ID NO: 38333 - DNA, 363 bp, Homo sapiens
  misc_feature 347: n = A,T,C or G
agcggccaacatggcggaacgcaggtatacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagtcttttcaccgagccctaaaagtaatgaaaatgaaatatgataaagacataaagaaagaaaaagataanggaaaagctgaaagtg

SEQ ID NO: 38334 - DNA, 316 bp, Homo sapiens
  misc_feature 7, 33: n = A,T,C or G
atgagtngaaagggaagatcgaggaagacagtnaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtcttt

SEQ ID NO: 38335 - DNA, 124 bp, Homo sapiens
caaggtgaaaatgccccaactaaatactaccgtatggcccaccataattacccccatactccttacactattcctcatcacccaactaaaaatattaaacacaaactaccacctacctccctca

SEQ ID NO: 38336 - DNA, 374 bp, Homo sapiens
caccatctgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagc

SEQ ID NO: 38337 - DNA, 431 bp, Homo sapiens
gtgtccgattcagacataccagggtttgaattcagatttcagcatttaactggctatgtaaacctggggaagttacttaaccctgtaaagtggcaataataacgcctattgcaaagaattgttctgagtcttgaacacataggaagagtactcagcataaagctagtacatagcttgttgctgcaattaagttatgaataacaacagtgcataaggagtaaagtaataaggcaggtctctctgagttttatggttctaaaacaaagtgttaggtaacacgtgttctgtaaatggcatctatagtaggatggtgctggctgtcacccttcagccacatttgttagcctctgtagctgtcagcaccttccagatgctttaaacaggctttgattatagttagtcttttgtgattcttgaagtttgattcattg

SEQ ID NO: 38338 - DNA, 144 bp, Homo sapiens
  misc_feature 7, 33: n = A,T,C or G
ataaatngaaagattacactatctgattaatantttcttcatactctgcatataatttgtggctgcagaatattgtaatttgttgcacactatgtaacaaaacaactgaagatatgtttaataaatattgtacttattggaagt

SEQ ID NO: 38339 - DNA, 156 bp, Homo sapiens
  misc_feature 20: n = A,T,C or G
cagtacgaatacagaccgtnaaagcggggcctcacgatccttctgaccttttgggttttaagcaggagaattgcttgaacccaggaggtggaagttgcagtgagccgagattgcaccactgcactccagcctgggcaacagagtgagactctgtca

SEQ ID NO: 38340 - DNA, 400 bp, Homo sapiens
  misc_feature 7: n = A,T,C or G
gaacacncaccatttttaaaaattatagctcatttaaaaaagctgccaattcaatgatgacacaatgctaagacactggcaatgaaaaaaatgcatctttatttcagaggttaaaaaaggtgtacatcttagaactgatgaaatacaacagataattttaggaagatgacatttgcattttggacttgagcagtgtggagggtactgatgccattaataggaatcatgggaacatgggaatgagaaatgagctccaaaagaaaagatgcattctcttttggacatattgagttggctatctctaaaagatattcatgtgcagatgtctggcagactattagaaatgctggtttggaactcaaggaaaaagttacaaaaaattggactaggttaatggatg

SEQ ID NO: 38341 - DNA, 205 bp, Homo sapiens
  misc_feature 23, 51, 85: n = A,T,C or G
gtccattctttgttgctttttanccttcattatgccatcttttatgtatcngaagtaattttgatattagatagtctaatctggngatccttttccttgtcaagcctggacttctagaataatgggaaagaaatagcaccagaatttggaatcttttgaagttgaagatgactgcaggattcagctgcttttctcttttattttg

SEQ ID NO: 38342 - DNA, 334 bp, Homo sapiens
  misc_feature 34, 35: n = A,T,C or G
atagtaccgtgactgccaaataatatttgaagtnntctgtctctttgtaaattattttatatgacctataaatttaaaaatgtttttcagtgagtgcttttaacaaacttaagcttctgccctgccaagggaattaatgttatcttgtgaaaggtgttgcttgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttg

SEQ ID NO: 38343 - DNA, 477 bp, Homo sapiens
  misc_feature 6, 7, 33, 438: n = A,T,C or G
atactnnccatggaattgatggcaaaatgagcntgttcaacagatggtgctccctgcaacaaatgtgaccacgtggttttactcacacactcccatatgccaggtcttacattatttattcgttcatttacacattaagagaacatttactgagtgccaattaattgccgactctgggcagggattataagtgggttagaataagccacaccttgctggtatgattgcgggtatggggaaaagctccgaactgttcccatctacttcttgtctcatgtattcatttactcaacacatatttattgaacacttgctatgtgctgggaactagtctagataccaggcctagaacaggaaacaaaataaagttcctgctctcatggagctcacattcttgatgcttgaaattagttcacagaggagtaaaatgttgcaggntgaacaataagaaataagacttaaaaaggtatccatgct

SEQ ID NO: 38344 - DNA, 461 bp, Homo sapiens
  misc_feature 33, 411: n = A,T,C or G
gttgtccctgagcaaccatctacttcttcgctncaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtacctggaaccattcaagtaaatggccatggaggacagccatcaaaacttgtgaagaggggacctgggaaggaaacctaaagtagaagttaataccaatagtggngaaattatacacaagaaaaggggtagaaagcccaaaaagctacagtatgc

SEQ ID NO: 38345 - DNA, 436 bp, Homo sapiens
  misc_feature 13: n = A,T,C or G
caataaccataanaaggaaatgctgtgagcatatgtttgtgtgtctagtgaagcagcaagagcagtgggagcttttgaggagttttgtggttctcagtcatctggagtaacagatccttaggagaatctgacaagagcaatggacttgcttcccagagacgggccaagtgtgatttctgccctactttaagggctcaccaactcctccaaagcctagtccaagtgagtaatccctgggttaggataagatgctacatttgagctgtccattcttgcatggaaatggggaggttgaccagatggccttctctggttttgaccatctacacccctgaaacgtgggccttctgggtgggtgcattgatcaggctgttgtgtctttatgttcagtaagtatcaggagcattctcctcttagcccacaaactctacaattg

SEQ ID NO: 38346 - DNA, 417 bp, Homo sapiens
  misc_feature 25, 49: n = A,T,C or G
tggtcattggcaatttcttcttttngatgctggaattttttcactgagncctatgagaagctattaaggggccagagacccaatgtattcggtctactacccactgtcccatgtttttcatccctatcagtgtaagtgatctgtcctgagagcaccgtcatctattaagcgaaatgcagatccccgggactccaagtaaaggacattcaggcataattgaggtgaaatatatggttatggacagagactctttgaaattttactgaatattttggattcctaaatggttaccttcaagacactgtgagtagcatatacatgtgtgtgcttgtgcatttgtacaagcacatgaacacggaggtaacataaatgcatttcatcccagaaaaacaaggataataataatgataagtcaga

SEQ ID NO: 38347 - DNA, 465 bp, Homo sapiens
  misc_feature 5, 30, 57, 381: n = A,T,C or G
caagnccgggatagagaagggcacctaaantttttgaagaaataatggctaaaaatntctcaaatttgatggaaaacattaatctacatatctaataatcttaactccaaatagaataaattcatagaaatccacattaaacttataatcacatttttgaaatccaaagacagagaaagagaagcaactcatccagtacaatggatccttgataagattaatagctgaattctcatcagaaacaatggaggccagaaagtgggataacattttcaaagtgagaaaaagatttcaactaataattctgttatcagcaaaaccattccttacaaatgaaggcaaaattaggacattcccagataaacaaataaagagacttcntcactaataaacatgccctgtatgaaatactaagaggagtccttggggcggacatgaaaggacactagacaaatccacatgaag

SEQ ID NO: 38348 - DNA, 460 bp, Homo sapiens
  misc_feature 1, 11, 56: n = A,T,C or G
naacccggtcntttggccggggttaggccacgtcgctttgaacgtgctataggttncttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatg

SEQ ID NO: 38349 - DNA, 386 bp, Homo sapiens
  misc_feature 22: n = A,T,C or G
agaaagtagaatttaaaaaccncctttcactggatgtgggaaatggtggaaagaaggaagtagaaaagaatggcttctggtttctggctttggcaactgggtgctaggcagaggtatgggcaatgaacatatcagagatgaacaagacaagattgctctccaccaagctttattgcaactggcagggcaggacagggagatgcaaacaacgcataaacaaataatttaatatgatatgtaatccccagaatagaggtaagataatgcaaataacccagactggagaagggaagactgggaaagcttccttcaggagatgatgcccaaataaagcctcaaaagacatgtaagaatgaattaagagaagaaaggcttggctaacacac

SEQ ID NO: 38350 - DNA, 102 bp, Homo sapiens
accatggccaacaacgaaggacttttctccctggtggcgaggaagctgagcagacccctgtgatgcctgtgacctcaattaaagcaattcctttgacctgtg

SEQ ID NO: 38351 - DNA, 233 bp, Homo sapiens
  misc_feature 17, 19, 179, 180: n = A,T,C or G
agtgatctgaaaacctncnccacacctgcagccccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatnngagatgtttttaattattttgattgctggaataaagcatgtggaaatgaccca

SEQ ID NO: 38352 - DNA, 440 bp, Homo sapiens
  misc_feature 6, 13: n = A,T,C or G
atttcnccaaggnaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttg

SEQ ID NO: 38353 - DNA, 195 bp, Homo sapiens
  misc_feature 25, 181, 183, 195: n = A,T,C or G
aaaatacaaaaatcggctgggcgcngcagcgcgtgcctgtagtcccagctactggggaggctgaggcgggagaatcacttgagcccaggaggcagaggttgcagtgagctgagatcgtgccactgccctccatcctgggaaccagaacaaaactccatctcaaaaaaaaaaaacccctttnanggcttttttggn

SEQ ID NO: 38354 - DNA, 464 bp, Homo sapiens
  misc_feature 390: n = A,T,C or G
atttttccggggagctttagtttgaaaagttgttgtttctgtggcaggatgtgaattctcaatgtaaatctctcttcctaagagatgagtgaaataaatggattcaaacaacaaataaaactgaacctctttgaagtccctttgaacagacttgatatctatcattgtgttaatcctacctctgtgatgcccttccctcctcaataaaatctcacacttaattcttaaagtatcccgttccttaaacattctctttaaaaactcttaaaagatttattgggtcacatattcagaataactacttgccatttgttattgtacctaacagtaatagtgcagtgtttgaaatgaaatggacctgagctccagagttcatcatttattatctgngtgactttgaacatattatataatcaccctaaacctttttcctcatcagtaaaatggaacttataatacctatg

SEQ ID NO: 38355 - DNA, 181 bp, Homo sapiens
  misc_feature 180: n = A,T,C or G
actacaatgagaccctactacgcatactgaaattgttcaagttaaaaacactgacggccgggcatggtggctcacgcctgtaatcccagcactttggggagccgaggcgggcagatcacaaggtcaggagatcgagaccatcctggctaatagggtgaaaccccatctctactaaaaatnc

SEQ ID NO: 38356 - DNA, 226 bp, Homo sapiens
  misc_feature 26, 27: n = A,T,C or G
attccagcaacaaccagtcaaaaatnnttataatttcccatagaattgcttcgtacctttgtcaaatatcaattgactatgtaattgaggatctgtttctagattctgttctgttccattgatgtacgtgtcttatcttcatgccaatactgtactctcttggtagctcagtggttctcaatgaaggacaattttgcccctaggggacatttggcaatatctggag

SEQ ID NO: 38357 - DNA, 395 bp, Homo sapiens
  misc_feature 34: n = A,T,C or G
aaatcatccggttgcattttatttttttctcttnaaaaattactgcaaaactaggttgtagcaagctaagtttcatcattattgtctagcaagctttatgtgccaagttatgaactcccagatattagagtttaaaatagcagtgatgccactataatattaatgataaatgtatgccatatgtttgaaacatttaaaaatgatcatagccttaaagccaaaaggagctggaaaatatcaatggtataggaactgtcctatttggttctgaattatatatagcagagagagatagagataaattgcataataaatcaaagttcacatggtatattgtttattttttaaaaaaaactacaaaaactttctgtttatgcaacatgtcagctatttga

SEQ ID NO: 38358 - DNA, 421 bp, Homo sapiens
  misc_feature 36, 61, 420: n = A,T,C or G
atcaccccataatatgcaggataatatccatttttnacaagaaactacagaaaataagtancaaaatctacaaaggttgtagtttagaaggtcaattacgtatgttttttctgcttctccacacttgccagatgtttagaataagcatgtaatactttgatactcaaggaaaaggtaaagactgaaaataaaaaaagttcggcagctctcatccaattcaaggctagcaaacgacaggagattttgaaaaatcagaatgatgtgtgtgtggcagtaggtgccctctaaattactttaatactatcactgagactatcattttaactcttaacttgcattgttttggacagttgctgggagagtcacaggtaggatagtctgatccctgtccagttagtggttccataaagtccagttagng

SEQ ID NO: 38359 - DNA, 232 bp, Homo sapiens
  misc_feature 204: n = A,T,C or G
cagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggngtaccgggatattaaacctctttcccca

SEQ ID NO: 38360 - DNA, 254 bp, Homo sapiens
  misc_feature 8: n = A,T,C or G
gatttcgnagaagtgtttgcttcggcagaaaacgatgagacgtgtaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccat

SEQ ID NO: 38361 - DNA, 403 bp, Homo sapiens
  misc_feature 348, 383, 388: n = A,T,C or G
gagggggcaggcggagcttgaggcaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttgnagggngattaaaataatttg

SEQ ID NO: 38362 - DNA, 233 bp, Homo sapiens
  misc_feature 52: n = A,T,C or G
ctatgttgatgtaatgcctgtggttttaagaaagacctacattgcttctttncagaatggaatcttctcagaaagtttacagaatcctccaggaggaaaggcattcagagtgttcgctgttgtgtgaaactgaatacttggaagaggaccataaagactattccaaatgcaatatttctgaattttgtataaaactgtaacattactgtacagagtacatcaactattttcag

SEQ ID NO: 38363 - DNA, 256 bp, Homo sapiens
  misc_feature 163, 164, 173, 224, 228, 244: n = A,T,C or G
gggctgcgaccctccatgagaagttttggacacttgggtcacctgacccgtgcctctctgacacatgtctccggggggcagccacctggccaatgtgcatttttgcacgtgctggaaccttccatgggggtctgggctattggctggagccaggacatgagtnnggggccccntggacctcacgtgccagggagacttgaatgtggctgtactctttccggacnccanggctgaaggaggctgnttgtgccctccc

SEQ ID NO: 38364 - DNA, 405 bp, Homo sapiens
  misc_feature 123, 165, 173, 323, 336, 368: n = A,T,C or G
tgtgtagcagcttgcattgacggggtccattcttggccttgcctaatcatttttcttggatgatatagagtgttacaaaagaattattatcttaatgaatcaggaatgttctctctatttgtnttctgacataggtaaagtgggaaggattagaaccttcaaggngaaatgtnaaactagaaatttccttttataatctgcttgtgttccccttggttttaggagctgggaatcccaagtgcaaaattgcaattgttttgggaagaactcaaaatacttctctctccaggtaattaaacaattctgattgagaaacctgtgtnggaatgagccagncttcctcctatctagggaatttacttaaaatncactgtttggactcacaaatcataatgtaagatatga

SEQ ID NO: 38365 - DNA, 336 bp, Homo sapiens
aggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggtt

SEQ ID NO: 38366 - DNA, 448 bp, Homo sapiens
agtttaaaataatgggttataagatattatttgcaagccttatggtaacctcaaataaaaaaatatacagtagatcacaataaataaaaagcaggaagttaaaaagtatcacctgaggaaatcaccgtcacttaaaggaaaataggaaggaaggaaagaaggaagagaagaccacaaaacaaccagaaaacacataaaatagcaggagtaagtccttagttatcaataataacattgaacacaaattgactaagcactccaatcaaaagtcatagggtggatgaatggataaaaaacaagacaccatcatctgttacctacaagaaacacacttcacctataaagacacacataactgaaaataaagggatggaaaaagatactccatgcaaatggaaaccaaaaaagagcaggaatagctatatttatatcagacaaagtagatttc

SEQ ID NO: 38367 - DNA, 468 bp, Homo sapiens
ctagataagtaaatatttaatagtccttaggtgagcaaacagtttgtaaactctacttactttaagcaaatttgagtgtctcttgattcttttatgtagaacattgtttgagccttccttgtttggcattttggcatttacttatattaataatattcatttatttactatttcatttataataattatgtaacatctgagtatcttggtagatgatgtcttataaatatgaccagactacaataatgatgaagataacagtaagtcaattttaggattatgtctttggactaattttgagtaattttgctacttttcactttattattattctcttaatgtagttagtccaattctaaggtttcagttataaaaataagaaaaaatggccaagcgcagtggctcacgcctgtagttccagcactttgggaggccgaggcgagtgggtcacctgaggtcaggagttcg

SEQ ID NO: 38368 - DNA, 425 bp, Homo sapiens
  misc_feature 30: n = A,T,C or G
cttccggttctgacggacgcttcggccgtntcgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcacttttggtctctgaattgaaatgctgtctactgaaagggtttcaaggagcgtttatgt

SEQ ID NO: 38369 - DNA, 164 bp, Homo sapiens
  misc_feature 6, 58, 128: n = A,T,C or G
cacccnctctaagatggatttaatgctcatttttaaggcatatactcagcttctatcntaaaactataatttaaaataattctgtacaatgaaatggggaatatatatggggaataaattctattccnttttatttcaatttggaattccaatggaaggtccct

SEQ ID NO: 38370 - DNA, 393 bp, Homo sapiens
  misc_feature 35: n = A,T,C or G
atgctaacaatgtcctatcagggggcaccactatntaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactg

SEQ ID NO: 38371 - DNA, 490 bp, Homo sapiens
  misc_feature 58: n = A,T,C or G
tgtttccaaatgcctgaaaaaatgaccatgatgcaaaaaccacaatatttttttgttngttgataggtaggaattcagggtccatcctgtcatcacaatgcaatgaaacaaaaaattagcaagtggatagcaataaatcaatttttaaaaatcagacaaaagaaaacactgtccttgtaatgcttgcatttaaaaggaaataaaaacttatgaaagagaatctttattttatttaagcagttctagattatacaaaatgttgaaacatctcaatttggtctctgaggctagcataatccttattccagaaaattgttcatcaaagatagctatagaccagtctcacttacgaacaaatgtaatttgttgaaactggtcatgttgaaaaaacatgaccaattaaatatcccaaaataatgtgtcatggtagagtagggtttatctgaaaactgcaacatgacgattatgtaactcaatcctttaggaaatt

SEQ ID NO: 38372 - DNA, 357 bp, Homo sapiens
  misc_feature 8, 30: n = A,T,C or G
cacaagcnatatggtcaacacataaaaatnattgtatttcttttgtttcttttttttgagacagagtctcgctctgtcacccaggctggagttgcagtgagccgagatcccgccactgctctccagtctgagcaacgagcgagactctgtcaaataaataaataaacaaataaatagacgtgtttacggtttggactcaatatagtaaagatgtcagctgtctcctgactaatctaaagatttctgattaatccaaagatttgataaaattctgatcaaaatcccagaaggattttttaaagatatcaacaagctgattctaaaatttatacaaagagacaaagaagctagaataac

SEQ ID NO: 38373 - DNA, 459 bp, Homo sapiens
  misc_feature 8, 357, 372, 403, 454: n = A,T,C or G
gacacagngagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgnggttgtcatgctggngactccttgagcctgtcctgtgctggaccgngaggaaggacacaaggccatccagactcctggactcacagggatttcttgncctcc

SEQ ID NO: 38374 - DNA, 223 bp, Homo sapiens
atagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaag

SEQ ID NO: 38375 - DNA, 260 bp, Homo sapiens
  misc_feature 109, 165, 220: n = A,T,C or G
agggagggagagagtgagagcgagcgagatctttggagagattttttttttgcctcctacttctgtcttgaagccagacaatcgacttcagctctccctcccctccctntttctccacgttctgctcccactcgctctcctgtccccttcccctcccctcccggnggaaagccccccgaaaccaacaaagctgagccgagagaaacaaacaaaacaaacncaccgggccagacaagccatcgacaaaactttgcaaaagc

SEQ ID NO: 38376 - DNA, 212 bp, Homo sapiens
agaaaaaagtgattcatggaaactatgtttggaaacataggataagcactctgacttgacaaaatgatttgtatttaaaaccatattgttggcagggcatagtggctcactcctgtaatctcagcactttgggaggtcgaggtgggcaagatcacctgaggtcgggagtttgagaccagcctgaccaacatggtgaaaccccgtttttactg

SEQ ID NO: 38377 - DNA, 183 bp, Homo sapiens
  misc_feature 7, 34, 156, 164, 170: n = A,T,C or G
attagancaaagtgtgccatgagagaaaaacttnaggagttttgaaaagtaatgcaaataacaaaactgcaacactatttttaaaaagataaatatctgagttaaaattactgaatctttattttacacctaaaaaaatatgggaacaagggaccntgcctttntggggnccctttttctggg

SEQ ID NO: 38378 - DNA, 274 bp, Homo sapiens
aactgagtgtaaagcagagtccaacaaatgtaatgtatgaagtataatttttaaaacattatgttgtagaccagcttggccaacatggtgaaaccccgtctgtactaaaaatgcaaaaattagccgggctaatttgcagttgcagatgcccataatcccagctactcgggagtctgaagcaggagaatcgcttgaaaccggaaggcggaggttgcagtgagtagagattgcaccactgcactgcagcctgggcaaaagagcgaaactccgtctc

SEQ ID NO: 38379 - DNA, 394 bp, Homo sapiens
cacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 38380 - DNA, 404 bp, Homo sapiens
  misc_feature 336, 341, 386: n = A,T,C or G
gatcagcccagcacaaaacctgggtctcttttcccatgactgtaccttggggtcccaggtcactcttgttcaacttagctcaaggttcaagtgcttccagaaggactgcagatagtggccagtcttcacgggtgacccacgattgtcttgcaccacaatcaggaactacaggttgttaaaaagaccacggatcggccaggtgcggtggctcatgcctgtggtcccggcgctttgggaggccaaggcggatggattgcctgaggtcaggagttcgaaaccagcctgatcaatatggtgaggccccatctctactaaagatacaaaaattagcttggngtggnggcgcacccctgtaatcctagctactcgggaggctgaggcagganaactgtttgagcccggga

SEQ ID NO: 38381 - DNA, 251 bp, Homo sapiens
  misc_feature 173, 194, 231: n = A,T,C or G
gatcccgcaggagcctctctccctactgctgcttcacaagaccctgagactgacctgcaggacgaaaccatgaagagcctgatccttcttgccatcctggccgccttagcggtagtaactttgtgttatgaatcacatgaaagcatggaatcttatgaacttaatccccttcnttaacaggagaaatgcaaatnccttcatatcccctcagcagagatggagagctaaagnccaagagaggatccgaaaac

SEQ ID NO: 38382 - DNA, 130 bp, Homo sapiens
tggtgggtgcctgtagtcccagctacttgggaggctgaggcaggagaatctcgaacccaggaggcggaggttacagtcagctgagaccgcaccattgcactccagcctgggtgacagagcaagattccgt

SEQ ID NO: 38383 - DNA, 160 bp, Homo sapiens
  misc_feature 159, 160: n = A,T,C or G
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcnn

SEQ ID NO: 38384 - DNA, 387 bp, Homo sapiens
  misc_feature 25, 179, 338, 383: n = A,T,C or G
gtacctgaaaacaacgatggcatgnaaaacacttcccatttacctgttgttgctgctgtctgttttcgtgattcagcaagtttcatctcaagagctttcctgtaaaggccgctgctttgagtccttcgagagagggagggagtgtgactgcggcgcccaatgtaagaagtatgacaagngctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttntagaatcagaggaaataacagaagaacattctgtttctgaaaatnaaga

SEQ ID NO: 38385 - DNA, 320 bp, Homo sapiens
  misc_feature 8: n = A,T,C or G
catctttntgatctgtagaactgtaaatttagtattttgtagcagtgctattatagtctgtgccttagcctcttccagtgatgaatctgagcatttagccccaagaggagtctcaatatttgatagatgagcatgatgtcagccctaaaagtaatccctacctttaataaattatcaaatttcatcaagtctcagatgacataatataaaatacaccattcttttatgtacttttaagaaaaaaaaaactgctgaagatggtcagtctactagatgatcccagcatcaaactgggacaccaaatgactcaggactagact

SEQ ID NO: 38386 - DNA, 417 bp, Homo sapiens
  misc_feature 20, 25, 99: n = A,T,C or G
gcacagtaggggtcccaggnggtgnaatcacacaggaataacacattctatgggaagaggaagacgagcctgtaaagcatttggagaaggaatgatcangagacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacataggtcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacact

SEQ ID NO: 38387 - DNA, 449 bp, Homo sapiens
  misc_feature 6, 32, 448: n = A,T,C or G
agcacntaagaagcatcctctgccaagacctnaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctaacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataaccgcatttctagtttctatatagng

SEQ ID NO: 38388 - DNA, 471 bp, Homo sapiens
  misc_feature 32, 54, 58: n = A,T,C or G
ggggtcccatctgaaggctggactggagaatntctacttccaaacttatgtggnagtncggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtattctactggttagaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaac

SEQ ID NO: 38389 - DNA, 202 bp, Homo sapiens
acccatcctcaggaaggctccaatctcctggctctctcagggcaggagggaaggcaggtcaacacttaaaagatgcccgatggccaggcgtggggggctcgtacctgtaatcgcggcactttggaagtccgaggcaggcagattacttgatgtcaggagttcgagaccagcctggccaacatggcaaaaccctgtctctatc

SEQ ID NO: 38390 - DNA, 377 bp, Homo sapiens
  misc_feature 35, 259: n = A,T,C or G
acgtaaagggacagagtattgggggacagaaggtnagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagngggagctctctttcccagctaactcacgcagtgtgacgcagaggctttcagcacagcccagggtgcccggggacttgaaaactccttcaccagccccctccacaggatttagaagact

SEQ ID NO: 38391 - DNA, 464 bp, Homo sapiens
  misc_feature 385: n = A,T,C or G
ctcattgcgaaaattacatgatgaagggaaactgggtgacttaatcaccttttgggtgatttaaatcatattttatcacttgaaagcagcgtttgtgaacttcccgtacaaacctaactaaggtaaatcaggattatgctgttttccttctagaaattatccaaaagttaaagacagagttaaaaaagaaaaaaaaccccagtgaattccatttttgttggaactaggagacagctattaatcagcaggctaaaaattactttaagcctaaaaaatacaggtgaggccgggcgcaatgtatcacgcctgtaatcccagcactttgggaggctgaggcgggtagatcacgaggtcaggagatcgagaccatcctgtctaacacggngaaacaccttctctactaaaaatacaaaaaaaattagccgggcacggtggcggggcaccttgtagtcccagctactcgg

SEQ ID NO: 38392 - DNA, 322 bp, Homo sapiens
tctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagc

SEQ ID NO: 38393 - DNA, 268 bp, Homo sapiens
  misc_feature 5, 7, 9, 27, 30, 31, 78, 88, 95, 148, 260: n = A,T,C or G
actcngngnctgggtcagccaagaacnatnnccaaacaaggacatggagggaaggcttcctaagggaagacttcctgncccaaaggangggagcngcgagaagaacgatgagacaaacgctgcctccctgactccactgggcagcagngaactccgctccccaagaatcaggtacctccactttttttaatcgtaacacctccatttgtattacatacggggtatgggtattgatgaggcatgggatcatatatgggatntttttctg

SEQ ID NO: 38394 - DNA, 135 bp, Homo sapiens
  misc_feature 7: n = A,T,C or G
tgctgangcagcggttaagagaaacgtgcagcttatagcaataatgtgtaacaaatagtgaattgtatgtattttaaagggttatactttggcatcttccccttgacaacagaataaaaattttagctgccccag

SEQ ID NO: 38395 - DNA, 469 bp, Homo sapiens
  misc_feature 7, 31, 34, 326: n = A,T,C or G
cagaacnagagggagaaagcagcatcttgcnttnatgagccaggggacacaggaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggnccagtgttctgatttgggtctggacaaagtgccaaaggatcttccccctgacacaactctgctagacctgcaaaacaacaaaataaccgaaatcaaagatggagactttaagaacctgaagaaccttcacgcatcgattcttg

SEQ ID NO: 38396 - DNA, 209 bp, Homo sapiens
  misc_feature 18: n = A,T,C or G
atagccctgttaaaagtnctgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaactt

SEQ ID NO: 38397 - DNA, 101 bp, Homo sapiens
gaaattccagcaagaatagaggtgaagacaagccaccaggactcaggagggaaacgctgaccattagaaacctctgcataagacgttgtaaggaggaaaat

SEQ ID NO: 38398 - DNA, 259 bp, Homo sapiens
atgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaact

SEQ ID NO: 38399 - DNA, 439 bp, Homo sapiens
  misc_feature 16, 384: n = A,T,C or G
atagtactgcataagncattgtaaacaatgttttgccccttagaaggcagtttatacatttatgtggatgtattctaatcgttatcttttatgtgcttagtatgacctcagtaaatccattgtaagaattagctaaacattgtttgggcgcagtggctcatgcctgtaatcccagcactttgggaggctgaggcaggaggatcacctgagtccaggactctgagactagcttgggcaacatagcaagaccccattctaccaaaaataaaaaattagctaggctaattaaaatggtggtgcacgcctgtgtggtcccagctacttgggagggttaagatggaaggattgcttgagcctgtgatgtggaggctgcagtgagtttgngatcatgccgctgattccagcctgggtaacagagtgacaccctgtctccaaaaac

SEQ ID NO: 38400 - DNA, 282 bp, Homo sapiens
  misc_feature 25: n = A,T,C or G
acccatctagaaagagaagtgagantaaaagcattattttagtctccttcctttcagtatgtgatccaggatggagaacacagtagggggcgttcccccaactattttctttccctggttcctggatcctggcacccatttaaatgtgctggccatgactgcaggcgtgaccctccaagccatggcaccagagaaactagacttctgggcccacttacacttccacaagcaccttagtcttttatttctttttgacctcctgtgtgacctgtgtgcttccct

SEQ ID NO: 38401 - DNA, 471 bp, Homo sapiens
  misc_feature 28: n = A,T,C or G
tagtcctggagcatttacaccttccggngaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcataggaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttg

SEQ ID NO: 38402 - DNA, 242 bp, Homo sapiens
  misc_feature 10, 32, 33, 34: n = A,T,C or G
cactcccggnaatattgaaatagctacaatannntaatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagcc

SEQ ID NO: 38403 - DNA, 287 bp, Homo sapiens
gagtccgagtggagagagcgagctgagtggttgtgtggtcgcgtctcggaaaccggtagcgcttgcagcatggctgaccaaccgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgat

SEQ ID NO: 38404 - DNA, 118 bp, Homo sapiens
ctaattaccaaggaagattgagcatatttttatgtttttattaaccattttgattttgtctcctgtgaagtgtctatcatcttttgcccattttttaacttgttgtctttttcttttt

SEQ ID NO: 38405 - DNA, 470 bp, Homo sapiens
gctctttcccttcggtgtggtgaccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccgtccacgtcatccgcatcaacaagatgttgtcctgtgctggggcttgacaggctccaaacaggcatgcgaggtgcctttggaaagccccagggcactgtggccagggttcacattggccaagttatcatgtccatccgcaccaag

SEQ ID NO: 38406 - DNA, 356 bp, Homo sapiens
  misc_feature 7, 145, 149, 153, 185, 219, 277, 311, 328, 354: n = A,T,C or G
gagattntggatcataagttagaaggttgattgtatgaatgggcaaatgtagcattaccatgttgatagttaccaagtcctagggccacacagcaaaagcaaaaccattagaagtagttttcctaaggctattggtttttttttngttngttngtttttaagtttacctcctaaggactcctcanagccactaggcaaggtcaggctgtaattcatctntagaaagagcacctgatggttaaaatggagtcaatatccattactttatcatagagtngatctcacaaaagggcacctgcatcatttagggngctttggttgcaagcantaaaattggactgcagttcacttaangc

SEQ ID NO: 38407 - DNA, 199 bp, Homo sapiens
  misc_feature 17, 199: n = A,T,C or G
tggtcaatggaaagaanggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggn

SEQ ID NO: 38408 - DNA, 460 bp, Homo sapiens
gctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaaggtggttctttccttgaagggcagcctcctgccca

SEQ ID NO: 38409 - DNA, 179 bp, Homo sapiens
aaatgggaccagttaaattcctcccaggcaaaattatcagccagaagattccaggggaagaattcaatttaaatatgtatcgcttgcatactttaagaacaagcagggagatgtgtatgcattggcgagaattttaaaaagataagatcagacccttcaaggaatataatcagacttta

SEQ ID NO: 38410 - DNA, 285 bp, Homo sapiens; identical to SEQ ID NO: 36546

SEQ ID NO: 38411 - DNA, 466 bp, Homo sapiens
attcctaccatgtgccagatattgttctaggattagcactggctcccaggaaaggtacagtcccttctttcttggagcttacaaattttaaatattaagtcaactagccattaagttttgtgaaaacagaaatgaatcacattggtggaatgtgcgagccagctgggaaataagactcatcttccagaaaccaatcagaaagccatgtctagagagtattattatggagttgaattgtgtcccctcaccacaaaattcatatgttgaagtcctaatccccatactcagcatgtgaccatattatagatagggtctttaaagaggtaattaagtgaaaagaagtgactagggtaggtgctaatccagcaggactgatatccttataagaagaggaaatgtggatacagagagaaggtgatacgaagaaagaggggagaagatgaccattgagtggccaaggagaaag

SEQ ID NO: 38412 - DNA, 311 bp, Homo sapiens
  misc_feature 3: n = A,T,C or G
aanatgaaagctctaaatgtatccaatagttttgctttcttatcagtgaatctatcagtatactagtagtaactggagaatttcaaagatatgcttacactttaaaccctcaatttccagtgcttcaggtgggtttgcacatatgacaagacaggcaaggagtaagaaggagccagtataagaattaaaaaggagaccgggcacggcgacttatgcctgtaatcctagcactttggtggccgaggcgggcagatcacttgggctcaggagttcgagaccaccctgggcaacatggctaaaccctgtctcta

SEQ ID NO: 38413 - DNA, 500 bp, Homo sapiens
  misc_feature 10, 18, 45, 49, 54, 69, 73, 83, 151, 419: n = A,T,C or G
ctttcccccngggaaccncggcccctctggcccggggagatgacnctgntgagntgagatgacctgaantaantgaaatgaantaactgacctgaaattgaaatgagatgagaagatactgagatgagatgaaatgatgaaatgataagantgaaaagagttgatgagatgatgagataaaatgatgagatgaaaagatgagatgaaatgatgagatgaaaagatgagatgaaatgatgagatgaaatgggatgaaatgaaattagacgaaatgtaatgagatgaaatgaaatgacataaatgaaaaaatgaaatgaaataatgaaatgaggtgaaattaaatgagatgatgaaattaaatgatgaaatgaaatgatgaaatggaaatgatgagatgaaatgacgagatgaatgatggntttgaaatgatgagatgcaatgatgagatgaaatgatgaaatgatgagatgagatgagatgtaatgatgagaggaaatgat

SEQ ID NO: 38414 - DNA, 200 bp, Homo sapiens
  misc_feature 30: n = A,T,C or G
agtaaaggactggttaatgataacaatgcntcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 38415 - DNA, 197 bp, Homo sapiens
  misc_feature 2, 10, 17: n = A,T,C or G
anagcaaaantatatantacaaaggtggacatctgaagccttgaatccttaagataaatttctaagaactaaatcgaagactatgataactttttaagacaatgtatatgccaaactatcctctagactagtcattttacactatcactgtctgttcttaagaaagtcatcccttctccaagaatgagtgttatcca

SEQ ID NO: 38416 - DNA, 175 bp, Homo sapiens
  misc_feature 92: n = A,T,C or G
gactgctaggggcttaagcggagggagtcgagccagcgtcgccgcgatggtgttgttggagagcgagcagttcctgacggagctgacccagnactttttttccagaagtgccggacgtcgggcagcgtctatattcaccttttgaagaagtatgacggttcgaaccaaacccatt

SEQ ID NO: 38417 - DNA, 462 bp, Homo sapiens
gaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgt

SEQ ID NO: 38418 - DNA, 436 bp, Homo sapiens
cgtgtctatgtgataacgtcggctctgtgaaacccaggggaactgacctgaccttgtaatgtgaggaacgtaaatttaaaatatcagcggagttgcattaaatgctttttcaggaggtttcattaatgtcaataagtatgaaacatttaaaattattgatttttggctgggtgcggtggctcacgcctgtaatcccagaactttggggaggctaaggcgggtggatcacttgaggccaggagttcaagacaagcctggccaacatggtgaagccctgtctctactaaaaacacacacaaaaaattagccaggtgtggtgggtgggcaccttgtaatcccagctactcaggaggctgaggtggaagaatcatttgaacccaggaggcagaggttacagtgagcccgagattgcaccactgcacttcagccccatctt

SEQ ID NO: 38419 - DNA, 463 bp, Homo sapiens
cttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggtt

SEQ ID NO: 38420 - DNA, 462 bp, Homo sapiens
catttcagggtcttggctgcctgtgggcttccccaggtggcctggaggtgggcaaagggaagtaacagacacacgatgttgtcaaggatggttttgggactagaggctcagtggtgggagagatctctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgt

SEQ ID NO: 38421 - DNA, 470 bp, Homo sapiens
  misc_feature 2, 27: n = A,T,C or G
anttcgatcctgtaagactttaacccntgggatcggacacatatttggactgcgacactgccagtggcttgcatgcctcatgcaaggctccaaccacttggaagaagctgaccggcgccctctaaacctttgccctatctgtttgcacaagttgcagtgtgcttgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactaga

SEQ ID NO: 38422 - DNA, 473 bp, Homo sapiens
aggaatatataggctacaatgaagagatatgttaattactcaaaacttactaagaagtgacatattagaattaggaggtagggaagtcaaacttgttattattactacattccacatgttcaaaaagttcaatggagacatgaaacatgtggaagagactcaaatcctaacttctacagataaaaactgcaatgtgcatgggattaacagtgaattagacattgcagaagaagatattagtgacctaaaaacataccagtagaaactatgcaaaatgaaatacagagggaaaagtgaacttaaaaaatgaatagctcatcagtgagctggggtacaacttcaagtagcctaatatacgtgtaagtccctaaaggagatgggagaatgcaaaaaatatttgaggaaataaggactgaacatttttccaaattggattagaactacaaacctataaattcaagaagctcagtgag

SEQ ID NO: 38423 - DNA, 465 bp, Homo sapiens
aggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctacactcctctgagtatgtccactcctctttctcaggattcctagtggctccaatgtgagtacaccccacagagctaatctaaatcttgtgctagaaaaagcattctctaactctacccca

SEQ ID NO: 38424 - DNA, 379 bp, Homo sapiens
gatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatggtaggattttcctcccatgaacatgagtaaataaatctgtttcctgaatgg

SEQ ID NO: 38425 - DNA, 385 bp, Homo sapiens
  misc_feature 5, 29, 102: n = A,T,C or G
agagnccagggtttcacccctgttggccnaggcctggtctcgaacctcctgaccctcaggtgatccaccctgccctcgccctcccaaagtgctgggattacnaggtgtgagcccacttgtgccctggcccaccctacagctttctttctttgaagatggagcttgaattagtgcaggttttatatattactatcaaggatggatggtctttaggaatgttcagagagaactttatagttctaacttactatttcagtagcatattttgaaaagggatggtttagaagtgacttggagttagggaaagagaaatacgataaattggaaagaagaaacttttcagaatattcatccaataaacatttaatgagtacccaatatttat

SEQ ID NO: 38426 - DNA, 495 bp, Homo sapiens
  misc_feature 2, 12: n = A,T,C or G
cngtccatatgngacattgtatattgatatttcacagcatatataaatgcaaggaagtgattatatgctttctctgcctactgaaaagatctagaaataatgcccaacgttgtagtgttgagtattcttatattgaagtaatctttcctgttaagagaaaagcttagagaaatggccgactccaggtctggcacaggaaatatataaaatgatcctggatatcttcttttcacaaatggcaatggtgttaatataatattatcaactgataattttagccacagatctgaggtttatgagctgtgcgctgaatatacttatttttgcagcaaggtctgtttaggggatgatcatgctttgaaacacagattgcattatatttcctctcccctaaatattaagtgcatggcatgggtttccatgtagtatcagagtgggatgcttgtcaatacatgaaaattctgaattatgatgtactcccaaaatacagtttag

SEQ ID NO: 38427 - DNA, 260 bp, Homo sapiens
  misc_feature 7, 12: n = A,T,C or G
ctgatcnagaangagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaatttttttggtcaaatct

SEQ ID NO: 38428 - DNA, 116 bp, Homo sapiens
  misc_feature 39, 115: n = A,T,C or G
gggctgtgccaagtgtgcccagggctgcattctgcaaanggacgtcagacaagtgcagctgctgtgcctgatgccaggacagcagtgctctcagatgtaaatagaagcaaccctnt

SEQ ID NO: 38429 - DNA, 331 bp, Homo sapiens
  misc_feature 257, 263, 293: n = A,T,C or G
gaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgngcaggnggataaaggaagagctggtttccggagagngactgtaacagcgttgactcgaagctagagatggaggg

SEQ ID NO: 38430 - DNA, 389 bp, Homo sapiens
gtgaaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaagtagatccatccaaatgatttctctgtac

SEQ ID NO: 38431 - DNA, 399 bp, Homo sapiens
  misc_feature 235: n = A,T,C or G
atctaccattcagttaaaccttctttatctcctcctctggcatccatttttccaaagaagagtcgagtcctctgaggtctgtgcttgaaaaccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggngtctttgaagcccaaccactcggtttccttcggattttcctccctttgttcgggggtttggcttggctcctctgtgtgtgtccgtatcttgttcggtgtcctcgaggttgagcttcactccactgcggcagaggcagcgtgcacactcggatttgctacgtttc

SEQ ID NO: 38432 - DNA, 399 bp, Homo sapiens
aggagcttcttgactagagagttactcgaaagaggccagagctgaaacttgtgtgtacattttgattgccagtatcagtttggaaaaatgtttaaacttaggtttaactttttggcatggtggcgcacatctgtaatctcagcactttgggagacagaggcaggagaattgtttgagtctaagagtacgttaccaacctaggtgacataacaagatcctgtctctaccaaaaacaaaataaattaggcaggcgtggtagcatgcacctgttgtttcagctactcaggaggctgaggtgtgaggattgtttgagcccgtgaggtcgaggctgcagtgagccctgattgcacaactgcactttggcctgggcaacagagtgagaccctgtctcagaaaaac

SEQ ID NO: 38433 - DNA, 351 bp, Homo sapiens
atccttttataagcttgttttttggctttgttggaaggtgtacttgggcttcgctcagcttgtaaattcctgttgtggccaggtatggtggctcatgcccgtaatcccagcactttgaggggccgagtgggggaggatggctttaggccaggagtttgagacaatcctgggcaacatggcgagactcgggtctctacagaaaaattagcctggtgtggtggtgtatgtctgtggttccagttccttgggatgctgaggttggcagatcagctgagtccagggaggtccagactgtggtgagccatgattgtgccactgcactccggcctgggcaatagggtgagaccctga

SEQ ID NO: 38434 - DNA, 469 bp, Homo sapiens
cccggcgctcctcaagtaggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttct

SEQ ID NO: 38435 - DNA, 370 bp, Homo sapiens
gacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttc

SEQ ID NO: 38436 - DNA, 470 bp, Homo sapiens
taggaagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgaattttgtatccccctgtagcagcattactgaaatacataggcttat

SEQ ID NO: 38437 - DNA, 468 bp, Homo sapiens
  misc_feature 22: n = A,T,C or G
tcttctcaatgcatttcttttngaataggttggtaattggtaaatagggaggagacaggagaagtgtttaaaatatggaaagagggttgaaaaacagggtttaaaaatcatgttgattttaattatcatatacaatgagtacaaaagaggaataaaatgataacaagccccttacagacaaaattattgtaagactaaactagaatgaccaaccatcccattttgtccgaggatattctggtattgacagtcctgcatcatatttaaatcctaaacttaaaatatcgttgctgattatgtgctaggttaatgattttcccccgatcttgctaataatctgaatgagctagagaataagttatattttcagaaactttccatgatatgtgaattcttcatcatttttatgtcaaatttattatttagtcaggtgcggtggctcacccctgtaatcctagcattttggga

SEQ ID NO: 38438 - DNA, 139 bp, Homo sapiens
  misc_feature 17: n = A,T,C or G
atggcacatgcagcgangtaggtctacaagacgctacttcccctatcatagaagagcttatcacctttcatgatcacgccctcataatcattttccttatctgcttcctagtcctgtatgcccttttcctaacactcgt

SEQ ID NO: 38439 - DNA, 379 bp, Homo sapiens
aaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtgcaacttgtccttagactgatgagcaaaggaggagtcaactaatgaagaaatgaataataaaattttgacactg

SEQ ID NO: 38440 - DNA, 463 bp, Homo sapiens
  misc_feature 37: n = A,T,C or G
gagagggagcctgagaaacggctaccacatccaaganggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaatttagaaagataaaaacatacttttagaaagaaaaaagataaatttaaacctgaaaagtaggaagcagaag

SEQ ID NO: 38441 - DNA, 255 bp, Homo sapiens
acagaaatacaaaccttccgtcaaaaccaaagacttaaggataggcatatacatgagaggaagtgaaaaagaaagccaagattttattaccacacctgccaaggtattgagcactgtccatcagagtccttaatcaatgacttaaaccagattttctcaacctttttttaacccatgttatgtcttctttgataaaacataaaattttcatgtttttctataaagttaaattttctaaatagatttccatgaact

SEQ ID NO: 38442 - DNA, 477 bp, Homo sapiens
atttctacaataagaactacaaaagatgggtggaagaaacctgaaataaaacaaactaatggaaaaatatcccatgttcatggattaaaaaaaattaaaaatgaccatggtgtccaaagcaatctaaagattcagtgcaatttctatcaaactaccaatgtcatttttcacagaattagaaaacaacaatcccaaagtgtatatgaaatcctgaattgaaaaaatgacccagatagccaaagcagttctaagcaaaaagaacaaagttggagtcagcacttcaccccatttcaaattatactacaaacctatagtaacaggaacagcatggtaccgatacaaaaacagatacatagtttaataaaattaaattagagaaccaagaaataaagccacatacctacaaccaactaatcttcaacaaagcgtgcacaaataaacaatgtggaaaggatacctttttcaataaattatact

SEQ ID NO: 38443 - DNA, 285 bp, Homo sapiens
catagtggctcacgcctgtaattccagcactttcggaggccgaggcaggaggatcacctgagatcaggagtctgagaccagcctggccaacaccgggaaacccagtctcttctaaaaacacacacacaaaaatcagccaggcgtggtggtctgcgtcttgtagtcccagctactcaagaggctgaggcaggagaattgcttgaacccgggaggtggaggttgcagtgagcaaagatcgcgtcagtgcactccagcctgggaaacagagcaacaagactccgtctc

SEQ ID NO: 38444 - DNA, 465 bp, Homo sapiens
gattctttctttgaggttgaagccctcatggaaaagagaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaacggcaatgcacaaagatgttgatacctcaatgcttagacgggcaatttggaactatattcactgcatgtttggaataagatatgatgattatgactatg

SEQ ID NO: 38445 - DNA, 477 bp, Homo sapiens
  misc_feature 368: n = A,T,C or G
ggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaagtacacaagtccaagtctaaaactttagtacttttccatgcagatttgtgcacatgtgagagggtgtccagtttgtctagtgattgttatttagagnagttggaccactattgtgtgttgctaatcattgactgtagtcccaaaaaagccttgtgaaaatgttatgccctatgtaacagcagagtaacataaaataaaagtacatt

SEQ ID NO: 38446 - DNA, 474 bp, Homo sapiens
  misc_feature 26, 448, 458: n = A,T,C or G
agagacacaacaaaaaagaaaatttnaggccaatatccctgatgaacattgatgtgaaaatcctcaataaaatactgggaaaccgaatccagtggcacatcaaaaagcttatctaccatgatcaagtcggcttcatcccagggatgcaaggctagttcaacatacgtgaatcaataaacataatccatcacataaacagaaccaatgacaaaaatcacatgtttatcttaatagatgcagaaaagtcctttgacaaaattcaacagcctttcatgctgaaaactctcaataaaccagatattgatggaacgtatctcaaaataataagagctatttatggcaaacccacagccaatatcatactgaatgggcaaaagccgcaagcattccctttcaaaaccagcacagggcaaagatgccgtctctcaccactcctattcaacatagntttgggaagntctggccagggtaatc

SEQ ID NO: 38447 - DNA, 258 bp, Homo sapiens
  misc_feature 155, 231, 233, 251: n = A,T,C or G
agctttactggctgtttgtatgctttggtttagtgcaatgtgtggtagattacttatcagaaaacatatatgtcatctctagaacgaagagaaagcatagtagttcaattcccagtgtgtccctttgattttttttttttaatagtaaaaataanaatctgtactgacttttcacttggccattctggttttaaaggacaagctacaagctctgggtttctgtactgatgngncacttattaaatactttngtcccac

SEQ ID NO: 38448 - DNA, 211 bp, Homo sapiens
aacctggctccctcccacccaaccaactttccccccaacccggaaacagacaagcaacccaaactgaaccccctcaaaagccaaaaaatgggagacaatttcacatggactttggaaaatatttttttcctttgcattcatctctcagacttagtttttatctttgaccaaccgaacatgaccaaaaaccaaaagtgcattcaaccttagc

SEQ ID NO: 38449 - DNA, 167 bp, Homo sapiens
  misc_feature 28, 32: n = A,T,C or G
gaatggcttggactgaacttgattttcnagcnaagggagtaagctgtaatgaggaaaaaaagcacaacctaaattggggggtgttatttaacctttgtgagcctttcatgcccctggaaaatggagaaaacagtctcggccttacaagattgttaggaacattaagt

SEQ ID NO: 38450 - DNA, 211 bp, Homo sapiens
  misc_feature 42: n = A,T,C or G
gttcctccttttcttaccctccccttttttcttctattaatnaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgcg

SEQ ID NO: 38451 - DNA, 126 bp, Homo sapiens
cacctgtaatcccagctaatcgggaggctgaggcaggagaataacttgaaactgggaagcggaggttgcagtgagccgagattgtgccactgcaccccagcctgggtgacaagagtgagactccac

SEQ ID NO: 38452 - DNA, 465 bp, Homo sapiens
gcattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaat

SEQ ID NO: 38453 - DNA, 194 bp, Homo sapiens
ggtggcccgctggggactggagtctcaacgacgcgcacacgagaagtaaggagcggaaggtgggaaagggccggaaaacacacgttcctccgaaaccggtttgcaagtccttgtagagagtgatagattcgtgtggcctttcaaatgattgtgaagtggtggaaatggatccaaaataataagtgacttctcta

SEQ ID NO: 38454 - DNA, 452 bp, Homo sapiens
  misc_feature 400: n = A,T,C or G
atatgataggattttgcaaactgtaaaatgctatgaagttccctttttgacagccttttgtatgttgataacagttactttttttatttggctgtccccagaatttctcttctgcaggtgtaaacacagttatattttgtagtgtgatatggtttcgtgcagagggcaggagacacattagtgccatgatgtagtgaaatagaaaacaaggcttttattttaaagcagacatggtgcagacaaagtacccttgatcctctgagcaaccatcacccccagagaagcaagcttaggctgggtatacccagactgcatgcaccaaaaggctcctccaaaccctgttgtgtctgccacaagtccatgtttatatttgtatgataaatagtatattttttttttngctcaaagggtattgccaatgaaatgatcatttgatactagtctataaagac

SEQ ID NO: 38455 - DNA, 185 bp, Homo sapiens
  misc_feature 29: n = A,T,C or G
atagtgagatattgtctctaccaaaattnaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtcgc

SEQ ID NO: 38456 - DNA, 466 bp, Homo sapiens
gtcacaatgaggtttatacttttgatctgggtagaatttgtgttcgatataaccaaaatgtatggatacctactgtgtgtctagcacttaagtaatttcttttatccaatggccatataattaaataagcaaaatttcacccaggggcggcagtctgagaattcaacacactaaatagaaaactagaagatgggagaatgctgtgtaaagagagagtgagcaccctgtgtgtttctaaagagaatggaaggaatttattcagcctatgtagcctctgtgtgggtaaggttttagttatgagataaatcaatgatcacaatattaaataagtcataccattgcacttatcagtgctcatgcagtgacatagtgaaaaaaataatgaagtagaaacatcagttccctgtatcaaaagctatgagatataaatactcccagccaaagaaggcaagatctgaaatttttt

SEQ ID NO: 38457 - DNA, 427 bp, Homo sapiens
cctggaggtgggcaaagggaagtagcagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgtaaaat

SEQ ID NO: 38458 - DNA, 468 bp, Homo sapiens
gaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacag

SEQ ID NO: 38459 - DNA, 468 bp, Homo sapiens
  misc_feature 15: n = A,T,C or G
attcctctttttttnactctttaaaaacataaaacacattcctagctcacaggccttactaagcatggtgcagaccttagtctgcccatccttgctctacagagagttttaaatgtgcaagaactaagggaatattgtgctcaggatcttttcctagtataggctgagcttcatctaaccaagaaatcattgaaaaatcttttgcaaaataattggcagttaagtgttgaacatatttaattataactctgagactaaaacaaaagtgagggtataagactacgtgaacagtacaaaaaatttatattgtttgacaaagtagaaataacacaactgaaaataaacgacaagaaaagggagggaaaaaagtgaaagtagaacaagttttttgattgcctcaaatataacaaggaggagtcagagcataattttagaggtagcaaatcaaaagcagaaggacaaattttt

SEQ ID NO: 38460 - DNA, 461 bp, Homo sapiens
gaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggcca

SEQ ID NO: 38461 - DNA, 230 bp, Homo sapiens
gacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacaccca

SEQ ID NO: 38462 - DNA, 477 bp, Homo sapiens
cattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctg

SEQ ID NO: 38463 - DNA, 269 bp, Homo sapiens
caggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaaggaagattggataaactttattggaaaatgct

SEQ ID NO: 38464 - DNA, 473 bp, Homo sapiens
gtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccac

SEQ ID NO: 38465 - DNA, 471 bp, Homo sapiens
  misc_feature 28: n = A,T,C or G
agaagaaaattggaagatagaaacaagnatagaaaatgaaaatattgtcaagagtttcagatagaaaatgaaaaacaagctaagacaagtattggagaaatatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttaccgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaattttggaaggccttaaatatagtagcttaagtttgaaaaatgtgaaggactttcgtaacggaagtaattcaagatc

SEQ ID NO: 38466 - DNA, 465 bp, Homo sapiens
  misc_feature 27, 28: n = A,T,C or G
gagagagtggggacgtccggcttcggnncgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcaactggggagaggatacactgatggagtatttggagaatcccaagaagtacatccctggaacaaaaatgatctttgtcggcattaagaagaaggaagaaagggcagactttaatagcttatctcaaaaaagctactaatgagtaataattggccactgccttatttattacaaaacagaaatgtctcatgacttttttatgtgtaccatcctttaatagat

SEQ ID NO: 38467 - DNA, 472 bp, Homo sapiens
acaggatgatttctgtcccacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattattttttaatgcattgtatttttgaagtaacgggttcagttaaaattt

SEQ ID NO: 38468 - DNA, 449 bp, Homo sapiens
aagcaaaagtttaggaaagaggatatttccatactctcaagatatctccctgtgaacatttatcatttacaaaggtaaaatgactaactttacagtggagagatctggaaaacacagttttaaccaagtgatcacggttaacatcaccagtaagtaagatgttgacttcatggaacccatgataagatgctctgagaagggcacagtacttttgaagtgctctcctccaagatgcataacctcagtataatcatgaggaaacctgaagaactcacagggagggacattcctcgaaatacctggcctgataactttaaaagtgttagcctcatgataggcaaagaatgatgatggaacactcatagattggagagactaaagtggcatgatgacttaactgcgatgtgggatcctgggttgggtcctggactaggcaggggcattggtgg

SEQ ID NO: 38469 - DNA, 174 bp, Homo sapiens
  misc_feature 169: n = A,T,C or G
aacatggcatagtagattttaattacaaggagagactagtttgatattgatatttgcaaactttatgccatcacattttttaattattggcaatataatttaattaagactattttaaaaaatacaattgcaggacacagattaaatgtaaataagttctgttaattangatga

SEQ ID NO: 38470 - DNA, 316 bp, Homo sapiens
  misc_feature 2, 14, 32, 46, 56, 82, 85, 94, 121, 155, 157: n = A,T,C or G
anaatcttctttgngaagaaattttgtgaccntttgttgccagtanaaactctatnacaacttggtctgctaacataaacanctngggaaagcncaatagacatcaaagaacactcacttnggaaaatgtccctgactgctgcgaccttcactgngnttcaaaatgacgaatttcttaatggccttgtccttgggcacgcatcaggcacggttcgtgcagcaaacaggctgcacgtggctgtggccctttttggcacaaccattgttccttcttttctttgtcatcttggaggcctggactgtagagaggactgtt

SEQ ID NO: 38471 - DNA, 211 bp, Homo sapiens
  misc_feature 25: n = A,T,C or G
aactgttttatttaattttacaagnaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccg

SEQ ID NO: 38472 - DNA, 160 bp, Homo sapiens
  misc_feature 7, 9, 17, 18, 28, 39: n = A,T,C or G
gtaagancntgaaagannttgtaaaatntcaccaaatantagaaatggcagttcaaagagaattgtggcagatgttgtgtgtgaactgttgtttctttgccacatgtgttgtatttgaaagttttacagtaagtttaaaataaaacattctgtgactgat

SEQ ID NO: 38473 - DNA, 375 bp, Homo sapiens
  misc_feature 2, 3, 44, 54, 146, 168, 224, 266, 325, 345, 347: n = A,T,C or G
gnnagatagtcttactgacactcagagtggattcttttgagtcngcactcttgnatacatccagcaaaggcgaaagaagaattcgtgttcatactttgtgtttgccagtagtttcgactctgaatgatgtctttcttggagctgangttcaagcaatttcagggttantggccaatatggctgttgacagatctatgactgccagtctgagtgacgctcgggangctctagtgaatgcaggcattgactccctttcagcttaccgntcttcagtcttaagtaaccagcagcctggactcatggttcctttttctttgcggctttngccactttttgggcgggctntncttaaacagaaatcattccagactggga

SEQ ID NO: 38474 - DNA, 160 bp, Homo sapiens
gatggaaaataccagtgttgggtttttttttagttgccaacagttgtatgtttgctgattatttatgacctgaaataatatatttcttcttctaagaagacattttgttacataaggatgacttttttatacaatggaataaattatggcatttctatag

SEQ ID NO: 38475 - DNA, 179 bp, Homo sapiens
  misc_feature 18, 82, 84, 85, 176: n = A,T,C or G
caagaaaggctctgtgcnttcgggttttccaggagactcaaaagctgaagaagcgaagaagagccttaaaggctgcagcagncnncccaaaaacaagcaaaggggaggaacccagacagccctgccaaagccataccgaagacactcaaagacagccaataaattctgttcaatcnttt

SEQ ID NO: 38476 - DNA, 364 bp, Homo sapiens
agaatgatctgtacatagattttggtggaaagtttcattgtgtatgtagaagaccagaagtggatggagagaaataccagaaaggaaccagggtccggttgcggctattagatcttgaacttacgtctaggttcctgggagcaacaacagatacaactgtactagaggctaatgcagttctcttgggaatccaggagagtaaagactcaagatcgaaagaagaacatcatgaaaaataaatgaactttgcttagtggattgactcctttgctgaagtcagttattcatcaagaatgcaattagactaattgtgaataaatgattgaatgaagatataataaaataaaagctataattataggat

SEQ ID NO: 38477 - DNA, 404 bp, Homo sapiens
  misc_feature 252, 389, 396, 399: n = A,T,C or G
tgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggnggaaaacaccaaattcactttctgttccattttaattaggtttcagaagtatcttggaaatcaaggtatgctgcaagaggatattaaaataagaatgttaggagagtccttttagaaagggcagtcttgggaatttnggaaaanggnttttt

SEQ ID NO: 38478 - DNA, 356 bp, Homo sapiens
  misc_feature 9, 19, 35: n = A,T,C or G
ctccaacgnacaaaacagnaacaattattataacnaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgc

SEQ ID NO: 38479 - DNA, 226 bp, Homo sapiens
agttaatataggtctaatcttattgctcactgtgtgcgaaggtggtgtaagttaaactgcccaaacaaatagatccaaaatgtaatgacatggcttaatatgacaaaaatgtatttcttgcttttgtaacactccaaggcaggtgttcaggttggctaggatgctcttcacatagcttataagggacacaggggaagagcttctcagcatctctcaagtgagctag

SEQ ID NO: 38480 - DNA, 171 bp, Homo sapiens
  misc_feature 1, 2, 25, 28, 49, 96, 152: n = A,T,C or G
nntttatattttccagccatccagnganttgtagtttatttcacgtgtngtcattggtaactctgcaaagtagtgggtttattagcacagatcagntaacatggggctccaagttcttgattacatgactcatgttcttccacaaacgcggngcttttgatgcttaaaaca

SEQ ID NO: 38481 - DNA, 310 bp, Homo sapiens
  misc_feature 19, 20, 23, 24, 42, 45, 64: n = A,T,C or G
ctccccgggaacctcggcnnctnnggcccgggaaggtttgangancttcctagccttgtcctanggaccctcaacaccaaggattacaaacttgcaaatttaataggtccttttgtactcaaaaggtcaattactgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaactg

SEQ ID NO: 38482 - DNA, 487 bp, Homo sapiens
gtctccccctgagtctggctgcccaatctgatttcctcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggacttggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccggggaagcaaaccgtgccctggtattgtcagacacacccaggcttgatttggatccacaggcagagccaaggga

SEQ ID NO: 38483 - DNA, 498 bp, Homo sapiens
  misc_feature 43, 49, 61, 71, 84: n = A,T,C or G
tattggccgggatcttttaaaaacctgcaacctgacgggatanacttanccttgcttagangcaaaagaangttgagttaaganaatctttggaaggggcttacaaccttttatggcctagaaactgcctttcttttcccacctaacatctcatttcattgccttcccctcatctacagagctatgtcttcatgcctatctggacagctgggtcctgatgggatctgaacagtagatactgccccggatcaggttaaatctggagcataggccagagtgaactagcttcagcataagtgaaataggtggatgattcaaagtgacggacttgtcgttatatgaaaaagacactcgcacatgcatgtttatggcagcacaattcacaattgcaaaaatatggaaccagcccaaatgcctatctatcaacgagtggatgaagatgatgtggtgtatatatatacacacacatatgatgggatgtgattatatgggaaatat

SEQ ID NO: 38484 - DNA, 393 bp, Homo sapiens
  misc_feature 9, 18, 29, 48, 55, 58, 61, 63, 64, 66, 70, 73, 74, 95, 125,356: n = A,T,C or G
attttaganctttagttngggaaagagancagtatacagtatcccttngtaaganaantcncnncncccnaannttaagttttcttgcacaaagnggataaatgagaaagtctttcttaaaaaangcttctttaactgtaacagcaaaactaaatgcatattttatcaaccccttattcctaattgctgtattcatttccaccccttaaactatttaagcatttcatctgctgaaagtccttatatacatggtagacggaatatttctccattaatgatagatcaaaatgaagatatttaaaaaattaacaaaatcaggccaaggcaggaggatcactttagcccaggaggtccanaccagcctgggcaacacagcgggacccccgactccac

SEQ ID NO: 38485 - DNA, 487 bp, Homo sapiens
  misc_feature 436, 485: n = A,T,C or G
ccctgaaaatcgtctccctccccttctcttgctgtacagcatgcgttctcttttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagnagctgtgcaaaccctgttattttttgtaaaaaaaaaaaaaatccctttntt

SEQ ID NO: 38486 - DNA, 400 bp, Homo sapiens
  misc_feature 13: n = A,T,C or G
gattctgctttcnaactgcctgactgcttgttcgtctcactggtgtgagctccagcatcccctttgctcgaaatggaccccaactgctcttgcgccactggtggctcctgcacgtgcgccggctcccgcaagtgcaaagagtgcaaatgcacctcctgcaagaagagctgctgttcctgctgccccgtgggctgtgccaagtgtgcccagggctgcgtctgcaaaggggcatcgggagaagtgcagcttgctgtgcctgatgtgggaacagctcttctcccatatgtaaatagaacaacctgcacaacctggatttttttaaaaataaaacactgagccatttgctgcattttctttttatactaaatatgtgactgacaataaaaacaattttgacttt

SEQ ID NO: 38487 - DNA, 207 bp, Homo sapiens
  misc_feature 3, 7, 27, 28, 36, 38, 50, 54, 61, 70, 85, 86, 98, 100, 110,119, 148, 169, 180: n = A,T,C or G
gancccnagggtcgcttttgctgtacnntcgtaatncnaccctgaggagngccnaagtacnaagttgtgnaaagtgaagaaaganncttttgtgggcncnaaaaaggaantcccttcantcttggtgacctcatgaatgcccccgcanccaatcccgcttacccccgantcccccttcantcaaagggtgaaatgaatacccatttc

SEQ ID NO: 38488 - DNA, 205 bp, Homo sapiens
  misc_feature 1, 48, 127: n = A,T,C or G
ntgcctggtcgtctcttgaaaagcagaggggctagttatccatgggancctggtagctggggtagaaaggaaaggccactttctcactttgcaggttgaaactgagtgaatgagccctgagacactnagaggggtccctttcttttgccccaacatctccaaaaacatttgcttccaagacacatgaaggacagatgtaattcta

SEQ ID NO: 38489 - DNA, 469 bp, Homo sapiens
tgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagtcatcatgtccatccgcaccaagctgcagaacaaggagcatgtgattgaggccctgcgcagggccaagttcaagtttcctggccgccggaagatccacatctcaaagaagtggggcttcaccaagttcaatgctgatgaatttgaagacattggtggctgaaaagcggctcatcccagatggctgtggggtcaagtacatccccagtcgtggccctctggacaagtggcgggccctgcactcatgagggcttccaatgtgctgcccccctcttaatactca

SEQ ID NO: 38490 - DNA, 498 bp, Homo sapiens
  misc_feature 17, 18, 93, 99, 158: n = A,T,C or G
tcccgggactctcggcnntttggccggggaaaactttaacccagtcttaatatagcaaggactaacccctataccttctgcctaatgaattanctaganataactttgcaaggagagccaaagctaagacccccgaaacctgacgagctacctaagancagctaaaagagcacacccgtctatgtagcaaaatagtggggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaatt

SEQ ID NO: 38491 - DNA, 475 bp, Homo sapiens
agttgtaccagccctattgcattttgacaaaggtacaaaagcaattcaatggaggaatgatggccttttcaacaaatgggactggaacaactaagaccaccacagaggaaaaaaagaatgaacattaatttgtacaaaaagttgactcaaaatggactgtagatttaactgtaaaatgtaaaactataacatttttagaagataatgtttgaggagataaacttttagaataatttaagagaaaatctttgggacctagggctccatgaagagtttttagacataatacccaaactataatccataaaagaaaaacaattaacaaattgggtttcataaaaaataaaaggttttgctctgtgaaagatctctttaagaggataaaaagataggcaacagactgagagaaaatatttaccaactgaatttctgacaaaggaattatacctagaatatgtaaaagattctcaagact

SEQ ID NO: 38492 - DNA, 494 bp, Homo sapiens
  misc_feature 6, 16, 25, 37, 62, 80: n = A,T,C or G
ctttcnccgggacccncggctcctntggcccgggatntccctcactgagcctggtctgtgangtcaagactttttctganatttagtgcacacaaaatactttttagacgtaattccaaaagtagtgtattaagttacacttttactttagtgagagcactcccttttgttcttttaaggggagaacaatatataagttttcttttctttagtgattgttcctttcactttttataattgacataagtatatttatttattgagtcaatttgttcaggtaagtactggggggcttcataagtcatgaggatgtttttatatataaatgtagcaaacatacattacagttcttactgtgtaatcgatgctccataataattcacaaatattcctgctggagttagtttgtaatttcaagtcagaaatgaaagatatcagtggtgaagaataagattgattcttcatatgggagtggacatttttttccagactat

SEQ ID NO: 38493 - DNA, 438 bp, Homo sapiens
  misc_feature 4, 27: n = A,T,C or G
gaanctcggtggtggccctgcgcagancagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcaggggaaggaaagaacttgcatgttggtg

SEQ ID NO: 38494 - DNA, 393 bp, Homo sapiens
  misc_feature 10, 21, 32, 45, 62, 105: n = A,T,C or G
acccgggaanctcggcaattnggcccggggangcgatgcgcgaanggcgggaccttggaganaaatactgagcacccacaacaggcagccagcacccactgcagnttggatacctgcaatgatgataagcatggcctgcctttaatggaggttctggatgttcctgtggataaccctcaaggagcacgggacctgggacatgactgcccccagcattccttctggcggcagacagagtttgtcagttcgccaacatcctgctttcatgagaacagtttgctgtttgctcacagagcctccagtggtatactgaagttggtcacgaccctcattccttcggcctccaacatctccccttttgtttttgcattaattgaataaaggtaattttca

SEQ ID NO: 38495 - DNA, 205 bp, Homo sapiens
  misc_feature 1, 6, 75, 77: n = A,T,C or G
nagccnagctgccgccctctgttgcctgatttcacccccttgtggttcctttcctagactcatcagctctaagancnactgcagtaagtacattagccccttacagcccctactcagaaaatcccttcttcctcaatgtcagtgggcttgacctccttgcttttatttatttttctaaattaattacaccagtacattctccttg

SEQ ID NO: 38496 - DNA, 102 bp, Homo sapiens
  misc_feature 1, 13, 19: n = A,T,C or G
natggcccgggantttganctgtgatttatttggagtggaggcattgtttttaagaaaaacatgtcatgtaggttgtctaaaaataaaatgcatttaaaccc

SEQ ID NO: 38497 - DNA, 357 bp, Homo sapiens
aaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccctttct

SEQ ID NO: 38498 - DNA, 468 bp, Homo sapiens
actcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatccccaaacatctggaaactaagtaacaaatgtctaaatgacccatgggtcaaagaagagaccaaaagagatgttagtattttttgaattgaatgaaggtaaaaaacagcatataaaaattggtgaaatgctgttgatatataggggagatctttatagtaataacttctgtgttagaaaagaagacaggtctcaaataaatggtctcggattccg

SEQ ID NO: 38499 - DNA, 478 bp, Homo sapiens
  misc_feature 47: n = A,T,C or G
gatatggttcctggcaagcccatgtgtgttgagagcttctcagactntccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgtttttgtggaccactttggttttcttttttgcgtgtggcagttttaagttattaagttttttaaaaatcagtaccttttaatggaaacaacttgaccaaaaatttgtcacagaattttgagacccattaaaaaagttaaatga

SEQ ID NO: 38500 - DNA, 481 bp, Homo sapiens
agggacacaaacattcaaaacataatagggctaaattcctgaattgcacagtgtcacttgagaggtaatgaataaaaatgaaagttgatatgataaactatacattatggcatcagtggaaatcggtttagtgagcatcaacttaggtatgataacatggggtccttgccctagaggaacctattatcttttccaagaatagtctgataatagattccatttatttttagaaacaaaatatttccagatgagtgcctatagtttcagcactttgggaggccgaggtgggaggatcactggagctcaggagtttgagaccagcgtgggcaacacggtgaaactccttatctgcgaaaaatttttaaaaaatttgccaggtgtggtggtgcatgccttgtggttccaactgctcaggaggctgaggttgggaggatcacttgagcctgagagatcgatcaaggttgcagagtgaactgtgatt

SEQ ID NO: 38501 - DNA, 259 bp, Homo sapiens
atttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtgcgt

SEQ ID NO: 38502 - DNA, 144 bp, Homo sapiens
  misc_feature 7, 24, 43: n = A,T,C or G
caagacntgttgaattaaccagangaaaaaaaactccttaganaaagtggtcaaatatttcaagtgaagtttggtggggaagtaaaatctttaagaaattactatgcatcattgtcagttaagtgcaatataaaatggacatac

SEQ ID NO: 38503 - DNA, 335 bp, Homo sapiens
  misc_feature 22, 39, 74: n = A,T,C or G
cgatgtgattggcttgtttttntgtggcgccaagacgancctgtttaacagctgtaaccaatggtactgatctntccctccaatgttgtcattactatttgactgtggttcaacagtattgcgttgtcagactaggaaagctaaacgaacaaaatggttttagttttgctgaagactggccttattaatggacagctttcctaacaagagattattaacttttattcaggtgttaacatctgtttcaggaacatggcagtatgtttacatgtccggaagttttgtttaattctatggtatttctaaattgacttgtttaaataaattcagcaaat

SEQ ID NO: 38504 - DNA, 294 bp, Homo sapiens
  misc_feature 142: n = A,T,C or G
agggaattggaagtgggaggaagaaagtgagcagtgcagttaggagtgaatggaatctttgagggattgtgtgtttgtgagtgactgaagtatatagcatgtggtgggaggcaacctgggagaaatacagcttaagagtcangattctggcctctaagaggtttgtcctaataatttggattcagtaatctaaagcttttacatttcagattctagaacccctttccaatgagatcttagttgattgcacccatttgggtaagaagttttaaagacttggagggcacagtctgc

SEQ ID NO: 38505 - DNA, 468 bp, Homo sapiens
gaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgaattttgtatccccctgtagcagcattactgaaatacataggctta

SEQ ID NO: 38506 - DNA, 179 bp, Homo sapiens
aagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcacctgttactcttg

SEQ ID NO: 38507 - DNA, 488 bp, Homo sapiens
  misc_feature 5, 16, 32, 317, 462, 467, 471: n = A,T,C or G
atctnggctcttgctnaatgccctatatcatnccagctatttgaccttggacaaggcccttctctggcccttggcaatgattcctttcatttgcagcagctgggtgtggacctagatgatcatggatgtctatgaatgtgaattttgaaagctttagtacagactatgctctaggagtttttagagttcctgggccaccccatccccattctggattccaaggctatggttctgccttagtgtgactgctgcagcatgttgtcaaacagcactttgactttccctgtgaccctaagtcagggactttccaaaatctnaaactctttcaaactcttttgaataaaatggaaggcatctcatctccagtccccatctctattcacctggatattgtgacatctcccactgggagaagatgtctcctgtctcccctgtgaccatgtatctttttttttggttggnttganacanaatgagaccttgtctct

SEQ ID NO: 38508 - DNA, 464 bp, Homo sapiens
agggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttaccgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttt

SEQ ID NO: 38509 - DNA, 212 bp, Homo sapiens
  misc_feature 11, 24, 31, 34, 37, 45, 85, 142: n = A,T,C or G
gatcctccatncaagtctgccggnggagganagnganaggagagncaattatgttcctgaggtcacagccttggctcagagagantatgtgaagtatgatcctgacactaaggaaatgctgaagcttttggacttcggcagnctgtccaaccttcaggtcactcagcctacagttgggatgaatctcaaaacgcctcggggccctggtcctg

SEQ ID NO: 38510 - DNA, 487 bp, Homo sapiens
  misc_feature 2, 426: n = A,T,C or G
angattggaagaagaagctcggacccttggtctaattcgcactttcctcacgagaattaaattaagcaaaaaacaaacaaacatagtgggccctcgtctagatcatgatgtgccagttttctgagacatctttttaaggctcttactgcagctcccctccccaccctcctcttctttgcaaaacagacccaagcagggcaggctcagaccactcgcttctttcagatctttcttgcaattatgataacatggagatttgctgttgtgcttttagagaaaagtctggactcagccacaaactctaataagacctgtacatctgagaacctttcccgttactgcgttttcaccacctgtcttccccatgctttatttatcttgtatgaacacagatttgacattacagctaaggaataatttggaggntgattcagaaatcctggcatgtgacaatttttgttaaattaccaagtttgggttttaaata

SEQ ID NO: 38511 - DNA, 213 bp, Homo sapiens
gtagtccgctttatttaaaaggaggtaaaattagccaaatatgatggctcatacctgtaattccagcactttgggagtttgaggcaggaggatcacttgaggccaggagttcacaagcagcctgggcaacatagacctcatttctacaaaaaatacaaaaaagaaaaagataataatttcttcttgccactgagcttaaggggaaaaaaaaag

SEQ ID NO: 38512 - DNA, 438 bp, Homo sapiens
  misc_feature 332, 350, 352, 407, 418, 432: n = A,T,C or G
tgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgaggggagaagattatgccgaatagacctctacatcctgggcntttctcctagtttctctncnccctggacattcgggagcaattaaaaccttttttccgaaaaaaaaaataaaactncccttttctgnaaaccttttttacntttttt

SEQ ID NO: 38513 - DNA, 467 bp, Homo sapiens
  misc_feature 451: n = A,T,C or G
cggcggcggaacgagggcaggcggctgagaaggcgagctatttgcattccccggcagtcatttttatatgcggagtaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccacttgagtgaaactgaaggctggntttccttgggaagcca

SEQ ID NO: 38514 - DNA, 355 bp, Homo sapiens
  misc_feature 35: n = A,T,C or G
agggaagccctgtgatgactacagaactttgcgancgctacgccatggtttatggatacaatgctgcctataatcgctacttcaggaagcgccgagggacccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatggaaagtgcactgcaggtgagggtcaaaggagagtcaacatatgtggattgttccataataaacttctggtgtgatacg

SEQ ID NO: 38515 - DNA, 469 bp, Homo sapiens
ataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatca

SEQ ID NO: 38516 - DNA, 476 bp, Homo sapiens
ggcaggcaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggag

SEQ ID NO: 38517 - DNA, 448 bp, Homo sapiens
  misc_feature 115, 188, 317: n = A,T,C or G
cggattccgacatgacggtcgcacccagcgacaggccgctgaatttgccaaaagtgctaggtggcgacagtgctatgagggccttccagaacacggcaactgcatgtgctccagnatcacattatcgagctgttgaaagtgtggattcaagtgaagaaagtttttctgattcagatgatgatagctgnctttggaaacgcaaacgacagaaatgttttaaccctcctcccaaaccagagccttttcagtttggccagagcagtcagaaaccacctgttgctggaggaaagaagattaacaacatatggggtgctgtnctgcaggaacagaatcaagatgcagtggccacttgaacttggtatcttgggaatggagggcactattgacagaagcagacaatctgagacctacaattatttgcttgccaagaaacttaggaaggaatctc

SEQ ID NO: 38518 - DNA, 468 bp, Homo sapiens
  misc_feature 1, 18: n = A,T,C or G
ncgtacactactacactnccagacctgggcgacagagcgagactccatctcaaaaaaataaaaataaaaaaacataatctatcaaactgtgtaaaaacacagtttatcaaaaaagtagttacccttggtgggtacttggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtt

SEQ ID NO: 38519 - DNA, 338 bp, Homo sapiens
  misc_feature 137: n = A,T,C or G
aatcacccatgccagctggggaccctggggggtggggagtgttctgggttgaattgcgtcccccctaaattcatacactgaggccctaacccccagtacctcagaatggagctcatttggaaacagggtcattacangatggaattagttaagatgacgtcatgctggagcaggctgggcccctactccaatgactgatgtctctatgaaaaagggaatttgggccgggtgcggtggctcacatctgtaatcccagtactttgggaggccaaggcaggtagatcacgaggtcaggagtttgagaccagcctggccaacatggtaaaacctcatctcta

SEQ ID NO: 38520 - DNA, 466 bp, Homo sapiens
  misc_feature 309: n = A,T,C or G
cacaagcttctagcactcaatcaatattcattaggctagaaggatataaagaaggaatcacatttgtcctacacagtactagtggaaaaataatgcctgaagttgcagccttttaaatatctagatattttaagtgacttaagatacataagagagacagcatggagtgtaagatttggagtcagaagtacctgagtctgaatcctaattctgccattggctctgtaaaggtaactccttcaccttcccaaaagttgtttatgggcagggcaccttgtaataaattcatcagcaatatatagaaaaggnctttactgtgtctaggttaaaacttggggaatttattgaaataggacaagaagggttatttcagaaatgagaaatttttcttagggttcttatgttgataccagtaaatacgtccatgatttcaaatcaaattcattgattgaatcaacagtaaaac

SEQ ID NO: 38521 - DNA, 498 bp, Homo sapiens
  misc_feature 2, 7: n = A,T,C or G
cntactnggccggggaaaccccaggtcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgtggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgta

SEQ ID NO: 38522 - DNA, 211 bp, Homo sapiens
  misc_feature 38, 42, 67, 75, 102, 151, 186: n = A,T,C or G
aggtgtgtgccagcatgcttgctatttttttttttganacanagtcttgctctgtcactcaggctanagtccagnggcttggtctcagctcactgcaatctntgcctccccgggagaattgcttgaacctgaaaggttgcagtgagccganattgcgctgttgcactccagcctggaccacagagngaggtctgtctcaaaaacaaggggg

SEQ ID NO: 38523 - DNA, 291 bp, Homo sapiens
  misc_feature 258, 270: n = A,T,C or G
ggcagcagtgagctttcagagaatcagcaaccaggagcaccaaatgctcctactcatcctgctcctccaggccttcatcaccaccataagcacaagggtcagcataggcagggtcacccagagaaccgagatataccagcaagtgaagatttacaagatttacaaaagaagctctgtcgaaagagatgtataaatcaattactctgtaaattgcccacagattcagagttggctcctaggagctgatgctgccattgncgacatctgatnttggaaaaacaggggctgcat

SEQ ID NO: 38524 - DNA, 169 bp, Homo sapiens
aggtacaggtgatgggttatgtgtgaagccacttcctcatccagggcccataggagtcatccctctcaaactaactcctcttcgactgaacctggccacagctctgagtccttctctgtgtggctgtgctgttcaggactcttaggtgcaaattttagaaactcaacgt

SEQ ID NO: 38525 - DNA, 463 bp, Homo sapiens
  misc_feature 391, 412: n = A,T,C or G
ctaaccaggccagtgacagaaatggattcgaaataccagtgtgtgaaactgaatgatggtcacttcatgcctgtcctgggatttggcacctatgcgcctgcagaggtaacaataatatttttagtgttgagagttcaaaggagctagagtaagtggaagctgaccaggtcgtcaggcttgtgttcccatgttactctgcatgactcccctttaaacgtcagtctttgttctgcaatgccgtcttgtcacagggtcatctactgcttatttgtggcactgttttgtcttctgtttatgtttatttcacagcttgtcagagtctataaaactcagcagaaagaacacggcttgcctgctccctctcttgaagattgattgcaatgggagtggnttctctgtttctttgtatagncgaacagatatttacttcttccaagaagatacaattcagaggaatttttat

SEQ ID NO: 38526 - DNA, 285 bp, Homo sapiens
agatgtggccatcgaacaccggaaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcaggggctgtctggttttaaataaaagttggaacact

SEQ ID NO: 38527 - DNA, 435 bp, Homo sapiens
  misc_feature 429, 432: n = A,T,C or G
tatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagatttttttttttaaactaccatggtcccaggattccatcctgaaatttatttttctttgatgaatatgggggaaatgatttaaaaataaaactgtaaaatatttnggncga

SEQ ID NO: 38528 - DNA, 301 bp, Homo sapiens
cccttgtaatgcgagtacttccagttcatgtcaaagattcttaattttttttaatcctaagaccaacgggaagccaggaaaatgttttatgtaagggagaaaataatccactttgcatttcggaaagctctacctagctgtaatttgtagaatgaattttgcatcctagagtgaatgcaagtagagcaggcaacagatatcggcagcttggaccaagggttctggcagtgaagacaaatggaagaggattcacaagaaatataagaagtaaaatcaatagaacttgatgatgaattgatgt

SEQ ID NO: 38529 - DNA, 475 bp, Homo sapiens
gcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatgggagtttatttggaggaagaatttggggattattcctctgtttgaaaaaagaggcttgctgtaatgtcacaggaaaccttttaaaagtggatctgtaatagcatattgtaagatgcactttgcagcag

SEQ ID NO: 38530 - DNA, 118 bp, Homo sapiens
  misc_feature 29, 118: n = A,T,C or G
gtttgggctgcttttagtttctcttaatnaaattactagatgatagaattcaagaacttgttacatgtattacttggtgtatcgataatcatttaaaagtaaagactctgtcatgcgn

SEQ ID NO: 38531 - DNA, 463 bp, Homo sapiens
cattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttt

SEQ ID NO: 38532 - DNA, 327 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttt

SEQ ID NO: 38533 - DNA, 421 bp, Homo sapiens
gaaagataggcttctatatggataaatagtcatgtaccacataatgatgtttcagtcaacagcagaccacatgtacaatggtggtcctataaggttataaaatacgtacttccactctacttttttaatgtttagatgtgtttagatgaacaaataccattgcattaccatgttacagctagaaagtgttaaggccaagatttgaatcctggtccttgtgattccacagctactcttccacaggtagggggaagagggaatatgatctctgaggagaaatcatctgtgaggtgcactgttttgaagggagcacatgatcatatgtaaccaaccagaagatatcagaaggttttctgaaaaactttttttttatatatggggaggtttcagcctgggcaacagagcgagactctgtctcaac

SEQ ID NO: 38534 - DNA, 381 bp, Homo sapiens
  misc_feature 42, 327: n = A,T,C or G
agagaagcaaacagtagttgtaatgatagtgtccttcctttntctgtttcttctcctaaaattcaagacacagcatacctttgtaggcctgaattggtaagaaggcaaggcaggggaggtgtgagcagtagaaataaccagggagaatgtttttgatgttctctatgtattcatttactccttttttcatgcattttacagatacttactgagtacctatttactgaacaccttatagatacttactgagtacctatttactgaacacctctgtgacagctctgagctgattactgtaaatataggaattctcctagcagatacagncactgcccgtcatagagcttttaaactagtaaagaagataaatattaggcattg

SEQ ID NO: 38535 - DNA, 234 bp, Homo sapiens
caatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttct

SEQ ID NO: 38536 - DNA, 398 bp, Homo sapiens
  misc_feature 395: n = A,T,C or G
gctagacttagattcttaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgnttg

SEQ ID NO: 38537 - DNA, 119 bp, Homo sapiens
ttgcctctcggcgccccctcgatgctcttagctgagtgtcccgcggggcccgaagcgtttactttgaaaaaattagagtgttcaaagcaggcccgagccgcctggataccgcagctagg

SEQ ID NO: 38538 - DNA, 126 bp, Homo sapiens
  misc_feature 2, 20, 22, 51: n = A,T,C or G
anctgccgaggcaagaaaantntttgaccttgtgacttgactgtggaagangatggttgcatgtttctagtttgtatatgtttccctctttgtgataagatgatttaataaatctctttaaatact

SEQ ID NO: 38539 - DNA, 487 bp, Homo sapiens
  misc_feature 7: n = A,T,C or G
gaaaganggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaaagaggttctcttagaagcacaagatattggcagtgagagaccataacgtggaattcaggtccaatttatatatagcctgagtccaccccaggacgaggccagtgcctgaaacgcatccgctaccatggcagaggtcgctttgggat

SEQ ID NO: 38540 - DNA, 473 bp, Homo sapiens
catttttgtgggggctagaaaaactaaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggaggggaggacccacactgctacacttctgatcccctttggttttactacccaaatctaaatagatacttttgataattagaataactggctcttttactaagacatagtctctacctatagaat

SEQ ID NO: 38541 - DNA, 212 bp, Homo sapiens
  misc_feature 5, 10, 48, 90: n = A,T,C or G
agccnagcgnggggcttctgctgagggggcaggcggagcttgaggaanccgcagataagtttttttctctttgaaagatagagattaatncaactacttaaaaaaatatagtcaataggttactaagatattgcttagcgttaagtttttaacgtaattttaatagcttaagattttaagagaaaatatgaagacttagaagagtagcatgt

SEQ ID NO: 38542 - DNA, 411 bp, Homo sapiens
  misc_feature 1, 15: n = A,T,C or G
ngtggccgggggcgntcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgc

SEQ ID NO: 38543 - DNA, 500 bp, Homo sapiens
  misc_feature 2, 8: n = A,T,C or G
anagcccntacaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttagtgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaaga

SEQ ID NO: 38544 - DNA, 479 bp, Homo sapiens
  misc_feature 68, 78, 467: n = A,T,C or G
caacgttgctggtgacagcaaaaatgaccccccaatggaagcagctggcttcactgctcaggtgattntcctgaaccntccaggccaaataaagcgccggctatgcccctgtatttggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtggggtgtcatcaaaagcagtggacaagaaggctgctggagctggcaaggtcaccaagtctgcccagaaagctcagaaggctaaatgaatattatccctaatacctgccaccccactcttaatcagtggngggaaagaaacg

SEQ ID NO: 38545 - DNA, 160 bp, Homo sapiens
  misc_feature 2, 4, 6, 18, 52, 68: n = A,T,C or G
antnanagagcttagcanagtgcctggtaatgaagcaagcattaccttgccnattacttttccttccnaccctctccgacatcacattcactttaaatttttctgtatatagaaaggaaaactagcctgggcaacatgatgaaaccccatctccactgcg

SEQ ID NO: 38546 - DNA, 251 bp, Homo sapiens
  misc_feature 8, 12, 40, 85: n = A,T,C or G
tcaggaantgangactcttgttgacctgggtggctgaganagtgacacctttgctttctgatggttcagggtacacaaactttanttacaggcaccaaaattactcaaaaatacggtataaaattaccttaaggctatgtatataaagggatgtgtgtatgtgtgtatacacacaaaaataaattttgtgtttccacttggatcccctccctaagataactcattgtgtacatgcaaatattagaaaatgc

SEQ ID NO: 38547 - DNA, 190 bp, Homo sapiens
  misc_feature 7, 16, 37, 67: n = A,T,C or G
gtcttantttctgtcnatgggaaagaacctcaaaganacccacaatggataaataacttagaaatantactaggtctgctgtagacctgatttcagaaaagcctagggcagtgactggaaataagtataaccattaagaaagatgaattgtgaaattcctttatttttctgaaacagtgtcaatatctgg

SEQ ID NO: 38548 - DNA, 489 bp, Homo sapiens
  misc_feature 5, 8, 24, 58: n = A,T,C or G
agagnccntttgccctccgtgccnaggccctgctcaggctgattggattgaccaccantcttttcagcaacggctcttggcttcctggcccacaaaagggggctacttgtgagaagtctaaagagagagggtgtctgtagtcacactctcttcttactgtatttgggatatgagtttggggaaagagttgcagtaaagttccatgaagacaaatagtgtggagtggggcggggagcatgaagataaatccaactctgactgtaaaatacatggtatctctttctccgtcgtggcccctgcttagtgtcccttacctggcttagcgttctgtttcaccagtttccaagtttattgccctcaaaatctttagaatagttaaatttggcttgtttaagggttcttgctgccccacaacacaccttgcccatgcacaaggaatgaattttttcctaccattatggctttgtgcttgttcttcctcttacctgt

SEQ ID NO: 38549 - DNA, 463 bp, Homo sapiens
  misc_feature 5, 14, 27, 31, 37: n = A,T,C or G
gttcngtcaggaanctgcagaaatgtnaganggagangtgagagatttgggcctggaaaaatgagagtttcagttactctacaaggctttttgttgcacatgcttttgatttcatgttaaaaggatattgtacaggcaattaataacatgctatattagtattattattattttgagacggagtcttgctctgttacccaggctggagtgcagtggcacaatctcggctcactgcaacctctgtctcatgggttcaagcaatttctcctgcctcagcctcccgagtagctgggattacaggcatgcgccaccatgcccggctaatttttgtattctagtagaaatggggggttcaccattgttggccaggctggtcttgaattcctgacctcaggtgatccacccgcctcggcctcccaaagtgctaggatacaggtgtgagccaccaggcccggctgattta

SEQ ID NO: 38550 - DNA, 153 bp, Homo sapiens
  misc_feature 2, 4, 33, 36, 51, 69: n = A,T,C or G
antngcccgggcttttcttttcttttttaaacnaantctgggctgggtacnagtgccttaacctgagangtcaaggctgcagtgagctatgatgcagtgagctatgattgtgccactgaactccagcctgggtgacagagtgagaccctgtct

SEQ ID NO: 38551 - DNA, 188 bp, Homo sapiens
atcaagcatactcaaaaggcatttgttaatggtatttattctagcaaccacaacattgttacaaaagcacaattttaataggcttatctgctaagatgcttttataagcagctgtcacctatacagagttatgaatcatctttggtgctcaaggaacctgtagaagtaagagacatcatcatacagag

SEQ ID NO: 38552 - DNA, 488 bp, Homo sapiens
  misc_feature 2, 6: n = A,T,C or G
antagnttcaagttacgaatccttgaccaaaatactgcataggtgaaggggtgttcttcttagatctggaggcatacgttgcccatctgtctgatttttttaatgttgattttattctcctgtttgaggtgctgtcttatttttccactatataattactatttttttcctatttgcaatcaataagcagtctgtggggagatgctttaagaccatgcacatatgctgctgctcatcagaatttccttctactttttagcatccactgctaatgggaaaagtaattttaatactctctcagtagttcgtagaacaaaaagatttgaaaacacttggcctaattgacatatacagaacattgcactatatagtttctgtatacttctaaatattcatgaatcaaagaagaaatcaccttggaaatttgaaaatgttttgagtggaatggcgatgaaagtattatctgtcaaacctttgagatacagcta

SEQ ID NO: 38553 - DNA, 498 bp, Homo sapiens
  misc_feature 6, 12, 36, 42, 151, 298, 365: n = A,T,C or G
cagctnggagangacaatctggctcccaacactgcnacgtcnagatgacccttcctacgccctgctgtccacggaaaggctcccagaacatcacctaccactgcaagaacagcattgcctatctggacgaagcagctggcaacctcaaganggccctgctcatccagggctccaatgacgtggagatccgggcagagggcaatagcaggttcacgtacacctgccctgaaggatggctgcacgaaacataccggtaaagtggggcaaagactgttatcgagtaccggtcacagaagancctcacgcctccccatcattgacattgcacccatggacataggagggccccgagcaggaattcgggngtggacataggggccggtctgcttcttgtaaaaacctgaacccagaaacaacacaatccgttgcaaacccaaaggacccaagtactttccaattctcagtcactctaggactctgcactgaatggctgacctg

SEQ ID NO: 38554 - DNA, 473 bp, Homo sapiens
gtgttaactgaagtttgcactctacagattagaggaccccatttcaagattgaaatttaagatcaaataatacctgaccatagtacagtatatttccctatttccattaaaatgattttaagcctgtgaacattaagaaatgttacatttggactacaaacattaaatataatatttgttttttttcttcctataaacagttttcattgctggcagaagccatatcacaggaacatcaagaacttaaagccagagagaaatctcaggcccaggtaataattaagatagaagccaagtcatgcactgcatggcaatgtttctttcagcaagggacctcgtacattggtggttggagcaataggctgtatcatatagccccggtgtgcagtggactgtactctctaggtttgtgtaagtacactgacattttgcacaacaacaaaatcatttaatgatgcatttcttggaacata

SEQ ID NO: 38555 - DNA, 242 bp, Homo sapiens
  misc_feature 178, 214: n = A,T,C or G
catcttagtaggtctattttttaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaancaacagccgcaggtggagagccctgttcacctgatngggtctagctgtgacagtaaatataata

SEQ ID NO: 38556 - DNA, 100 bp, Homo sapiens
  misc_feature 9, 16, 82: n = A,T,C or G
cttgagtanccgggangtcgaggcttcagggagcctattgattgcttcacctgaccctccagccctggggtagcagtggaancccctgtgtctattttaa

SEQ ID NO: 38557 - DNA, 480 bp, Homo sapiens
ggctggtctcctactcccagatgcatccgtgtcaaaacatgttccaaatcaagtatagatattgagaatgggtttatttctgaatctcagtatacatatgccttaaaagaaaaagcaaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagaagaatgcgaacttcctaaaatagatgtacacttagttcctgatcgcaagaaagaccagtataaagttggagaaaggggttg

SEQ ID NO: 38558 - DNA, 207 bp, Homo sapiens
gaaagcccagagtatagacccacataaaaatggtcaactgatttttgatagaggatcaatggcaatacagtggagcagggatactcttttaaatcaatttgctggaacaaatggatgttcacatgcaaaaaaccgaatttagtcacagaccttatgccttttgcagaaattaactcaaaatggatcatagacctaagtgcaaaatgc

SEQ ID NO: 38559 - DNA, 458 bp, Homo sapiens
  misc_feature 10, 383: n = A,T,C or G
cagacaaggnaaaacagaaatcttatgttgccaagttgtctttgctcttaggtgggttatcttggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaagaattagctgggactacaggtgcatgccacggcgcccagctgattttttgtgtttttagagagaccggggnttcaccattgttggccaaagatggtctcaatctcttgaccttgtgatccacctgccttggccttccaaagtgttg

SEQ ID NO: 38560 - DNA, 162 bp, Homo sapiens
  misc_feature 1, 16, 42: n = A,T,C or G
ncacttgatgctgccntccaccggaccccttcaaaaagagtntgttgccagaatcggccaaactggaacaaagtctgtcttctcacagagtggaaatagccttagaggtaactccaattcttgcacaaacacaaagttctggtccacaaacaagtacaacac

SEQ ID NO: 38561 - DNA, 403 bp, Homo sapiens
  misc_feature 19, 20: n = A,T,C or G
gttgttataattgatgatnntcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaaagtaagttcacttatagtatttctat

SEQ ID NO: 38562 - DNA, 373 bp, Homo sapiens
tatcccagaatattatatccactgaaaatatccttcagatgtgaaggagaaataaagacttcccagacaaacaaaaactgaggggtggccgggcgtggtggctcatgcttataatcccaccactttgggaggctgaggcgggcagatcacctgaggtcaggagtttgagactagcctggccaacgtggcaaaaccccatctctactaaaaataaaaattaaaaaattagctgggcatggtggctggcgcctgtaatcccagctactcaggaggctgagacaggagaattgcttgaacccgggaggtgggaggttgcagtgagctgagatcgcaccattgcactccagcccggacagcaagaggaaactgtctc

SEQ ID NO: 38563 - DNA, 487 bp, Homo sapiens
agatatgtagttggaaaatggaggacttcgcagaccccctgaaagtctcggggacccaacgggtccttggatgacattttgagaactgctgaactgctgtaggattagatatatggagggtggtacgaagagaattgattgtgtttaagtgttgacagaataaggaagttataaggagcatgaaattaaagactagaagtagtaattgatagaaggaggtttttgaagaagaatgggggattggggtcctagctgacttagagttaactttggaagggaggaaggaacttaggattttttaataagtcactagcacattgtaaggcttgaataacatgacagcttaggcaggaaggaggcaaggatggatgagagaagtaagttttgaagcagggtgataggaaaaaaaaagggttccaatctggttaattctactgtgtgtatgtgcatatatgcatgtgcatactctaggaaacaaaagttttat

SEQ ID NO: 38564 - DNA, 301 bp, Homo sapiens
  misc_feature 10, 25, 32, 78, 81: n = A,T,C or G
atttttcttnacccccagggaactnccggttntttatggcccggggaagaagtgacacagtacaggcgacagcgtcgntgnagcaccaacttctattccacggaggcagacagcgaaaaccatttcataaccatggcaaggcatgagagaagcacagggtagcttgcaaagttttggaaaagacctctgcaacaactggaagcacagtgtacccaagtggtgggtctcgtctgtggcaatataattttctatctgtccaattgaatatggctgtaaagggaataaaaccccatgtaatctc

SEQ ID NO: 38565 - DNA, 479 bp, Homo sapiens
  misc_feature 35: n = A,T,C or G
taggaagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgc

SEQ ID NO: 38566 - DNA, 128 bp, Homo sapiens
gatcgggagcagccccactggacctaggtgccccatctgttggtcatccatcctgaagggacaggaaacctcccaggcagttatttttttttctctatatttctagtaaagttttcgatatgtttctc

SEQ ID NO: 38567 - DNA, 469 bp, Homo sapiens
  misc_feature 331, 358: n = A,T,C or G
gtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagttnagaagaagactactcctccacctctgnggggagggcctgacatcagtcaggcccgcccgcagttatccagaggcctgtctccctgtgatgctgtgcttcagtggtcacgctcctagtccgctttcatgttccatcctg

SEQ ID NO: 38568 - DNA, 336 bp, Homo sapiens
gaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatac

SEQ ID NO: 38569 - DNA, 316 bp, Homo sapiens
gcacctgctatatccaaagatctagtattccaaagctctccaggtgattccagtgacacagacacacgtttggactgtcttgtactatgctatgccctgttctgctcttttttgaattggaacatgagaattgaggtccatgtaattttgagtttcagtagttttttgctcacattagtctcatttttgtttttcctcttgtagctgccatttatcaaatcgaaattatttcctcagagaaaaaggtttaggtatcctaagactttaaaatctcagtacgtttttttttaaagtatgttgtctcattctattgaga

SEQ ID NO: 38570 - DNA, 449 bp, Homo sapiens
  misc_feature 24: n = A,T,C or G
cgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttggtttaaaagttgtaggtgattaaaataatttgaaggcgatcttttaaaaaga

SEQ ID NO: 38571 - DNA, 226 bp, Homo sapiens
gattttgcggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcggggtattcatcgggagactaaatccagcggccagggagaaggacgtgg

SEQ ID NO: 38572 - DNA, 102 bp, Homo sapiens
caaaggacatgaacagacatttctcaaaaggtgtcgtaacaagcagacaagaaacattaaaaattgctaaacttcactaatcatcacataaattcaaatgtg

SEQ ID NO: 38573 - DNA, 384 bp, Homo sapiens
ggcgcactagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatctccttgtaaatttaactgttagtccaaagaggaacagctctttggacactaggaaaaaaccttgtagagagag

SEQ ID NO: 38574 - DNA, 165 bp, Homo sapiens
gtacgactcttagtcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 38575 - DNA, 484 bp, Homo sapiens
  misc_feature 7: n = A,T,C or G
aaaagangaaaacaaaacaggagggactcttaaataacaagcccttgattgcctaattagcctgaatgccctcactttcattggaattcactgctttgatggtgtggaggtgcaaagaggccagctatcaaagagagacgccacttatctaaacaaaatccaggaacagaattcgagacccttgtctctcagatgaagattgtttgcccagtataagagatttcatcctcgcttttgatagaattatgattcttgggaaatctttacgtggaaaaaactgcctcagaataaacaccaagtgtttcaaaataactacaggaagtccaagccacagcaaaatttaaatctctatttacaaaatgaaggtattcattcccttattcattcagtcaccaaacacttctttttaaaacatttttctttatgtctcatggattagaccctaggcattagtgaattaatgcaagagcatttatctctttgt

SEQ ID NO: 38576 - DNA, 408 bp, Homo sapiens
  misc_feature 144: n = A,T,C or G
atctgaaactgtgtaatttataatgaaaagaggtttacttgtgtcacaattctgcaggctgcacagaaatcatggtgccagcatctgcttatcttctggggaggccccacgagcttttacttatggcaggtgaagtggtaccangacgtgtcacatggcgagaatgggagcaagaggtgcgtaaggtgccacacacttttaaacaaccagatctaatgagtactcactcactaccatgaggacagcaccaagccatgagggatctgcccccatgacccaaacacatcccaccaggccccaccttcaactttggggaatacaattcaaaatgggatttggtggtgacatatattcaaactatatcattccattcctggcccctcagagctcatgttcttctcacactac

SEQ ID NO: 38577 - DNA, 119 bp, Homo sapiens
catctgtaactagatattggtttttcttctccatagtaagatcacctgatatttgataatttatgcttttattactacttgttttatgataccaacatttatgttcacatcctcaaggc

SEQ ID NO: 38578 - DNA, 294 bp, Homo sapiens
  misc_feature 7: n = A,T,C or G
caggagnctgaggcaggagaatcacttgaacccaggaggcagaggttgcagtgagctgagatcacgccactgcactccagcctggtgacagagcaagactctgtctcaaaaaaagaaaaaaaaagaagaagaaagccccatcgtctcagtccaaaaactccttaaactgataagcaacttcagcaaagtctcagcatacaaaatcaacgtgcagaaatcacaagcattcctttacaccaacaatagacaagcacagaaccaaatcatgaatgaacttccattcacaattgctac

SEQ ID NO: 38579 - DNA, 475 bp, Homo sapiens
gacagtgcaccaagtatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggaggtgctgatggcacgaagggcccagtagggagcctctctgggaagctcttcctcctgcccctcccattcctggtgggggcaagaaggaagtgtctgcagggaaacagcttctcctctgc

SEQ ID NO: 38580 - DNA, 206 bp, Homo sapiens
  misc_feature 4, 7, 27: n = A,T,C or G
actngtnagtcagagccagtatctggnaacagatcaacaggaccacccattaagccaatctgcaagtggtgccaaaacatctgtgagcatgaaacaactggaaagccatatgcgaggcaaaataaatcttgacccttatagcctaccatataaaaaattaacttaaaatggatcatagacctaaatttaagagctaacacaatact

SEQ ID NO: 38581 - DNA, 328 bp, Homo sapiens
ctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgc

SEQ ID NO: 38582 - DNA, 192 bp, Homo sapiens
  misc_feature 22: n = A,T,C or G
gatgagcaatatttcttccagnaagtaattttatacataaggcaagaatagtctcctagaaaaggaatggctgtggccgggcatggtggctcacgcctgtaatgccagcactttggaaggccgaggtgggcggatcatgaggtcaggagtttgagaccagcctggccagcatgctgaaaccctgtctctact

SEQ ID NO: 38583 - DNA, 475 bp, Homo sapiens
gggtgtgggaatgcttgatgaattatcttaggttacacaacatgcagttctttggaatgcatatacatgtatattatacatactttggatagacacttgtatttgaatactgagtagtatataaatgatgaagtcattttagagtttgactgtcaggcagttaacatttgttgctttgtggttttgtcataatatgatccttactaattaggtgcagaatattcagaatattgagtagtatctggttacatctcttttatgacatatatataaatataaaaatatttatctaaaacttaaggtttaatgatatttatacaatattaaaacagtataggaatatacaaaaatacaaggcctggcacggtggctcacacctgtaatcccagcattttggagggccaaagtggaagaattgcttgagcccgggagttcaagaccagcctgggcaacatagggaaggccccatctctac

SEQ ID NO: 38584 - DNA, 481 bp, Homo sapiens
gtttggttaagagaactaaggaatttgcccagtcaatagaatacatcgataaaccattgtcattttggagccatttttcagcaccctttttggtcctcagatactgcattgacatacataactaatagattttgtacataatgctgttgatcctggcaaatgaacagccaccttaagtcatctgcctggtatctcgagtgacttggcaaggatctggcatgaggtgtcacctgacttcatctgctcctttcactacagactggttctttgcatttataaacctcagtctggcctcaatagtggtttccttggttgagagtcatcttattttcagctgaagacatgttacctccaggatgctggtaaacatgttgcaagactaagttctgatgaatctcacaagactcctctatagagaatgaactgaaaccgaggagctgacagtgttaataattcagcatttggcagcactgtggatatt

SEQ ID NO: 38585 - DNA, 108 bp, Homo sapiens
  misc_feature 30: n = A,T,C or G
gctcaatctgcaatgggccacatacctagnatctccagatgtcatttcccctctcttattttaagttatgttaagattactaaaacaataaaagctcctaaaaaatcg

SEQ ID NO: 38586 - DNA, 111 bp, Homo sapiens
gctcacagtgtcagataaagcagggaaaggaacagagggctgtaatgggcctgccccctagcggggagccaaaggccagcttttatcttctcagagaaacaagcagaggtg

SEQ ID NO: 38587 - DNA, 491 bp, Homo sapiens
  misc_feature 3, 5: n = A,T,C or G
gtngnacacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaac

SEQ ID NO: 38588 - DNA, 208 bp, Homo sapiens
  misc_feature 38: n = A,T,C or G
ctcccctgaactctacacaacatattttgtcaccaagnaccctacttctgacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacgtt

SEQ ID NO: 38589 - DNA, 465 bp, Homo sapiens
gtttctgttttgtggattagactgctaaataagcgaagagttaattttgaagttcaggtcaacaaattcctgtttggagacgggctgttcttgaataccaggttgttatctgtctattacagccccttcacttctgggctcctggccctttgcgaagtacttcagaaagcctagagagaagagagggccctcaaatcccattccagcccctaaatgaaagtggcatcacaaggagaaaagtggaggtagaaatgtaccatgggggacgttgccccattgcctttcttcccctgactactgggcttcctctatcagcttttaacgtctggaagtagctgagtctccagtcactggtggccttccccaagtgagctcagcagcatgtgctaataggtgccaatactgtgctggctccagtgggattcctctctgcaaagctgctggcttagcttgactgtttcccta

SEQ ID NO: 38590 - DNA, 139 bp, Homo sapiens
ggggcggtggagatgcctgtctacaccagtcctgtccccaggactccccttctgtggtctggaggttctaggctggcctgggctcttaaagggaggattttgcaggctgtcctccctaataaaagattttcccaaggtc

SEQ ID NO: 38591 - DNA, 166 bp, Homo sapiens
  misc_feature 26, 53, 66, 90, 116, 127, 156, 165: n = A,T,C or G
gagggcattgctgctggcctggctgncctagcagttgtggtcatcggagctgnggtacgctgctgngatgtgtaaggaggaagagttcangtggaaaaggagggagctactctcangctgcgtacanagacggtgcccagggctctgatgtgtctntcacagctng

SEQ ID NO: 38592 - DNA, 471 bp, Homo sapiens
ggacatgtacatgcggtttctttgggcaggaacaccctcccttctaccatggtctgtaggaattgaaccttccgtgccgttttcaaatgctgtctgtgctcggaaaatacataatatcaagtcccttactgaaccccctacagatcgtgttcataaggtgcttcactgctgttggtctacctggcctactgtttgtactcctgcctcatttactgtggccttcattcaagtagtaatgattatttacctattaagagtatagggtgggcgtggtggctcatgtaatcccagcactttgggaagccaagatgggtagatcacttgaagtcaggagtttgagaccagcctgggcaacatgatgaaaccccatctctactaaaaatacaaaagttagctggatgtggtggcagcctcctgtaatcccaactactcggcaggctgaggcaggagaatcgcttgaacccaggaggt

SEQ ID NO: 38593 - DNA, 466 bp, Homo sapiens
  misc_feature 404, 420, 454: n = A,T,C or G
gggttcccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttactttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttatttgatgaacagcagattctacattggcagcactattncccggaagcggatgcnccttcagcaagcctttggcagaacagcaacagcnaaataacacatt

SEQ ID NO: 38594 - DNA, 226 bp, Homo sapiens
aacactttttcctttcttcgagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtg

SEQ ID NO: 38595 - DNA, 452 bp, Homo sapiens
  misc_feature 5, 131, 419, 438: n = A,T,C or G
gatgnctactttgcaaatttgtgacttttaagtactaacacatttgattgaatgtgtattgaattggaattattatttctaaattcagcatttgagtccttagttgatgattttcttttaaagaaattagnttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaagggtgctgacacacagtgatgtggagggcattcccggagaaacttttgcaacagtgtattaatgtgattggttttctttttgttttaagctaaacatctaaaacaaatttcaagttaacagttcatacaactnagatttagtattattggtnatcataaaacatat

SEQ ID NO: 38596 - DNA, 171 bp, Homo sapiens
  misc_feature 9, 10, 11: n = A,T,C or G
gaaaacagnnnaaaaaaattatatcaagtatcaataatcagaatagctttacactgaaaattagatgacaatggagcaatgccttcaaaagtctaagggaaagacatttccatcctagaactctacttcaagccaaactctccattaggagtcaaacacttgtagacatcc

SEQ ID NO: 38597 - DNA, 420 bp, Homo sapiens
  misc_feature 2, 25: n = A,T,C or G
gnaggcagcccagcgcaggggcttntgctgagggggcaggcggagctcgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgatt

SEQ ID NO: 38598 - DNA, 286 bp, Homo sapiens
tatggccggggagacagcagtagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagagg

SEQ ID NO: 38599 - DNA, 319 bp, Homo sapiens
  misc_feature 24, 180, 182: n = A,T,C or G
aaaaggaaaaggatgccttagcanggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaatnantgagaagagcaatatactatcaaatgaaatgaaagctaagaataaagatgtaaaagatacagaaaagaaactgaataaaattacaaaatttattgaggagaataaagaaaaatttacacagctagatttggaagatg

SEQ ID NO: 38600 - DNA, 441 bp, Homo sapiens
  misc_feature 2, 4: n = A,T,C or G
tngnaatactactcagcaataaaaaaggtaacaaactactgatacacatgacaacctgaatgaatctccaggggattatgttgagtgaaaaaaaggtaactctacaatattacaaactgtatgattccatttatagtccattctcaaaatgacaaaaatcgtagacgtggagaacagattagtgattgccagaggttaaggagtgggtgtgagtgagagggaagtgatcatggaaatgatcagtatcttgactgtatcaataccaatatcctagttatgatatcataccatagtcttacaagatgttattgttgagggaaacaggtttaagggtaaagagatctgtatcagtacttacaactacatgtgaataaaaagacaactgatgaaatgggagaaaatatttacaacagaccaagggctaaagaactcttaaaactt

SEQ ID NO: 38601 - DNA, 111 bp, Homo sapiens
gctgctcaggaggctgaggtgggggggtcgcatgcactcgggaggtggagattgcagtgggctcggattgtgccactgctttccagcctgagtgagagagccagaccctag

SEQ ID NO: 38602 - DNA, 249 bp, Homo sapiens
attgtgccaaaactttcagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 38603 - DNA, 489 bp, Homo sapiens
  misc_feature 33: n = A,T,C or G
tatggccgggcactgatccagaacacttcaagnaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccat

SEQ ID NO: 38604 - DNA, 287 bp, Homo sapiens
  misc_feature 11, 12: n = A,T,C or G
cggggggaacnncaatacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggcccccaaaagagctagcagaatccgcaaacttttcaatctccc

SEQ ID NO: 38605 - DNA, 357 bp, Homo sapiens
  misc_feature 19: n = A,T,C or G
tactacccccaaaatagtntattcaataatattaattaaaaaggaaaaaggaaattgactgaaacagaaaacgtgggccaagacccaaggtcttgtgctgggatccccttgcttagaactatcatgttcttgaagctgctgatccaagaactgatggactgaagacagcgtgtaccctaacctgagggggccaccacacccagggcccacaaacttgatctcatggtaactcctgtcctttctgtcccatgagccacattctgaacagcctgatcaggatcctcaaccgtcaggtcataagatccgagcaacattttccttccttttgttagtttattggggttgttttggtgtttg

SEQ ID NO: 38606 - DNA, 440 bp, Homo sapiens
  misc_feature 2, 8: n = A,T,C or G
cnataagnaaggtcaaatgaaaagtgtgctttcatctgacatttttagatattattggaaacgatcaagaacttaaagcacatagaacataaacaggcaatgcgtattctttctgggagataagaagggttttgctatgttttaaaaatatattattcaaaaattacagaaaagcttgagttatagtaaaattattcatacttttgaaatccttgttgacaaatctatattattagtgtatttgggcacttctctattctacaatttaattactaatttacattaacagctttttactggattctgaccacccagcattttcaaagcagaaatccaaagttctaccttagaaagtacattcttcaatttgctagtttatcttcctcaaaaatggttcattaattgctcagtttcctctctattttgaattaattataaac

SEQ ID NO: 38607 - DNA, 228 bp, Homo sapiens
  misc_feature 3, 6, 33, 134, 159, 201, 213, 215: n = A,T,C or G
ganatncccgcctctttccgcgccgacacaatngtgcgcatgaatgtcctggcagatgctctcaagagtatcaacaatgccgaaaagagaggcaaacgccaggtgcttattaggccgggctccaaagtcatcgngcggtttctcactgtgatgatgaancatgggtacattggcgaatttgaaatcattgatgaccacagngctgggaaaatngnggggaacctcaca

SEQ ID NO: 38608 - DNA, 177 bp, Homo sapiens
aagcctcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagc

SEQ ID NO: 38609 - DNA, 145 bp, Homo sapiens
  misc_feature 4, 6: n = A,T,C or G
cgancnccgtggcgggcacctgtgatgccagctgctcgggaggctgaggcgggggaatcgcttggacccgggaggcggaggttgcggtgagccaagatcacgccactgcactccaaactgggagacaagaacgagactctgtctc

SEQ ID NO: 38610 - DNA, 433 bp, Homo sapiens
  misc_feature 2, 21, 46: n = A,T,C or G
cntttatggccgagaaagaanaaacaaatccactgccttccaaagnaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttg

SEQ ID NO: 38611 - DNA, 463 bp, Homo sapiens
  misc_feature 3, 6: n = A,T,C or G
gcnctntccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatac

SEQ ID NO: 38612 - DNA, 262 bp, Homo sapiens
agcgggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagctttccgggaaaccaaagtctttgggttccggggggagtatggttgc

SEQ ID NO: 38613 - DNA, 347 bp, Homo sapiens
  misc_feature 2: n = A,T,C or G
cnttgtaattattctctaaaattttaaagaggaaagcataaaaatgatcataaactgttcatcataatctggtaataatacacaacaacaatatgattactgacatcaataatgaagttgagggcagatgtaatgaggaggaattttcaaattcaatggaagttaagtttttaccagtttaaaatatattattttaacttaaagaaattttatgtaattctcaagataccagaaaaaaagtatctgtatagatacaccaaaaaataagaattaaaggtgtatcaatacaaaaataaaaaagactaaggaagacagaaaaagaaaataagggacaaagataaaataat

SEQ ID NO: 38614 - DNA, 369 bp, Homo sapiens
  misc_feature 7: n = A,T,C or G
gttatgnggatttcttcatccgtcagatccacaaatttgaggagatggagtcttgtgctgtcacccatgctggagtgcagcgacgtgatcttagctcagtgcaacctctgcctcctgggttcaagcgagtctccctcctcagcctcccgcatagctggaattacagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagac

SEQ ID NO: 38615 - DNA, 456 bp, Homo sapiens
  misc_feature 7, 38: n = A,T,C or G
tgatggnccggggaaaacctcccctgtagattctaaancacatatgtaactgagaaacgtggtactgctgagggaccctgaacaaccctctttatagctgagcagatgtgaagtatgatggaggaggaagcatagatcattgcaacgtttgagccctgggtgatgggaagaatcatttggatacagagaaagggatacagtcgggaagtcagaccagaggactggtcagaaatgaccggatgaggcacttttgggcttggtgtggtactgcacaggctcagggagatgaccatgaggcagctctaacctaggtggggaaccggaggacctgggtgtgcagattttctgcttatatttgacagtttgtaaagcccttgatttagatgagacctgtgggacaagactgtaaaaagggcacgaaacgaatcccagagtaaccagattcagcgggtgaga

SEQ ID NO: 38616 - DNA, 440 bp, Homo sapiens
ctgtttgaataagaacaaaacgctaaggtgggtagcctaagctgattttctgctggttacacgtgtctctcacaccacatttcctcaaagctgatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggccgaggcacgagaatcacttgaacctgggaggcggaggttgcagtgagtcgagataacactactgcattccagcctgggtgacagagtgagactccacccc

SEQ ID NO: 38617 - DNA, 252 bp, Homo sapiens
  misc_feature 12, 17, 49, 51, 122, 169, 191, 194, 251: n = A,T,C or G
atggtactgtcngaaanccccaaagggatactgttataatcagatgaangnaaagtattttgtaaattatagaatatcctttttgtaaagtctctttctttaattcaacagaataaactccnggaaaagatctatttgattaagagaaacagaggagataggaaatgtnaaggggggggactatttttgtnggnatctaggcaaaagctgggcctcacttctgcgggctgaaccctttgtatgtgcccagng

SEQ ID NO: 38618 - DNA, 293 bp, Homo sapiens
  misc_feature 290: n = A,T,C or G
aaaacaccgcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacncac

SEQ ID NO: 38619 - DNA, 496 bp, Homo sapiens
  misc_feature 198: n = A,T,C or G
aagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgtnatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttat

SEQ ID NO: 38620 - DNA, 326 bp, Homo sapiens
  misc_feature 7: n = A,T,C or G
tatggcncggggttcctctcctcccacccaatgcacccgagtttcctcacctgtaacgtgaccagagttgggcttccaaacattttcttccagtgaaattttacatggaaacttgagctgtggaagagacagaaggctgctgtagtgaggtgggggtgataggaagaggactgggaacccccttttcttataccccagatatccctatggctcccttgagctcagtcagaaagccacatgtggccttactgcttcttaaatttttgtttgttggcaaggaaaggtcatttttgaaaaaacaataaacgaataacaattttaaaatg

SEQ ID NO: 38621 - DNA, 478 bp, Homo sapiens
aagaagcagtaaatctgaaaacttgatacctcctgatttaaagatatattacaaagctacagtaatcaagacactatggcactaagctggacatacaaattaatgaaacagaatagagagcccagaaataaacccacacagataaaaatcaaatgatcttttacagaggtgccaagactacacatggggaaagaagagtctcttttaacaaataatgttgggaaacagaataatcatatgcaaaagaattaaattatcttataccacccacaaaaatcaactcaaaataaactaaagacctgaagataagacctaaaactataaaactcctggataaaaatataaagaaaagcctatacaacactggtctttactgcgatttcttggatatgacaacaaatgcacaggaaacagaaacaaaaatagacaagtggtactacctcagactaaaacacttctacagagcaaaagaaacgat

SEQ ID NO: 38622 - DNA, 475 bp, Homo sapiens
gctttccacaagtaggcgccgaagcgaataaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacatttgatgtggccaaggtcaacaccctgattcggcctgatggagagaagaaggcatatgttcgactggctcctgattacgatgctttggatgttgccaacaaaattggga

SEQ ID NO: 38623 - DNA, 477 bp, Homo sapiens
  misc_feature 3: n = A,T,C or G
aanttccctatggatcagcaattatcacttacatgacacccaagtcttccaaacagcaggaaaaatcggtgtctgttttctatgcaatagtgactcccatgcttaatcccctcatctatagcctgagaaacaaggatgtgaaggcagctctgaggaaagtagccacaaggaatttcccatgaaggcttggaatctcacactgacagtgagctcagagaaccttttggcttcctacttcaaagacttgctgggaagacatggaatcaacccaggtggattggatttttaaaaatgtacattggcacacttggtttctcaagtcacctgcttggcccccttccaagttgtactttccttctttttcctcctttccttttccttccttactgttctaaagctttttaataaactttctcctgctttgaaaacaaaagtacatatacaccatggaatactatgcagccacagaatagaatg

SEQ ID NO: 38624 - DNA, 201 bp, Homo sapiens
  misc_feature 25, 127: n = A,T,C or G
gtggccgaggttgacaaggtcacangcaggtttaatggccagtttaaaacttatgctatctgcggggccattcgtaggatgggtgagtcagatgattccattctccgattggccaaggccgatggcntcgtctcaaagaacttttgactggagagaatcacagatgtggaatatttgtcataaataaataatgaaaaccta

SEQ ID NO: 38625 - DNA, 384 bp, Homo sapiens
  misc_feature 22: n = A,T,C or G
aatgtgagtaaatatgcatagnaaacattcagctacatcaaggtgggaggattattgaggccaggagttcaagaccagcctgagtaacatagtgagacctgtgtctctttaaaaaaaagaaaagaaaaaaagagaaaaaaaaattagccagacttggtggcaggccactgtagacctagctactcaggaggctgaggcaggaggatcacctgggcccaggagtttgaggctgtaataagttctgattgtgtcactgcactccagcctgagcaatgagattcagtctttaaaaagaaagaaagaaagaaagaaaccagctacagttaaacatatgtatgcatacctatgacctagtaattctgctgttaggtatatatggtatat

SEQ ID NO: 38626 - DNA, 119 bp, Homo sapiens
  misc_feature 6, 8: n = A,T,C or G
cgcagncngctcacgcctgtattcccgcactttggaaggcctaggtgggtggatcacctgaggtcaggagttcgagatcatcctggccaacatggagaaaccccatctctactaaaaat

SEQ ID NO: 38627 - DNA, 454 bp, Homo sapiens
  misc_feature 3, 211: n = A,T,C or G
ggnggccgataggtctctataaaaagaactacaaaatatggcagaaaaaaaatcataaatgacacaaacaaatgggaaaacattccatgctcatggattagaagaatcaatgtcattaaaatggccatactgcccaacacaatctacggattcaacactattcctgaaaaactactaacgttatttttcacctaattagaaaaaaattgtnctaaaattcatatggaaccaataaagagcccgaaaagccaaagcaatctctaagcaaaaagaacaaagctgggagcataacattacctgacttccaactaaaaggctacaacaaccaaaacagcttggtactggtacaaaagcagacacgtagaccaatggaacagaagaaagaacccagaaataaagacacatatctacaacaattagatctttgacaaagttgacaaaaataaggaatggg

SEQ ID NO: 38628 - DNA, 323 bp, Homo sapiens
  misc_feature 3, 5, 27, 37, 46, 47, 49, 63, 65, 66, 68, 72, 80, 86, 116,140, 142: n = A,T,C or G
atncnaatggaagaaaagcgagctgantggttgttgnggacagcannanagaaaaaccggaancnntngaanaatggctnaccaantgactgaaagaaacaaattgaagaattcanagaagctttttcactatttgacananatggtgatggaactatatcaacaaaggaattgggaactgtaatgagatctcttgggcagaatcccacaggaggcagagttacaggacatgattaatgaagtagatgctgatggtaatggcacaattgacttccctgaatttctgacaatgatggcaagaaaaatgaaagacacagacagtg

SEQ ID NO: 38629 - DNA, 500 bp, Homo sapiens
  misc_feature 4, 11, 31, 34, 44: n = A,T,C or G
aaancacccgncttctttatggcccgggaanaanacccgccagnacaaaggttcatttgtaaagtaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattct

SEQ ID NO: 38630 - DNA, 217 bp, Homo sapiens
  misc_feature 213, 214: n = A,T,C or G
ctaatccctgagtatttactttaagaataaaaggggatgaaacgagattggccatgagttgatcattgttaaagttgggtgatggctacttagagttgcattattttagtcacttttacttttgtatatgttggaaatcttccaaaacaaaatgtatagccataaaaaaaagggagcaaagtaagaaaaaaaggagagtctaaaaaaaaaggnncag

SEQ ID NO: 38631 - DNA, 472 bp, Homo sapiens
  misc_feature 58, 67: n = A,T,C or G
gaagatccgctgattagcatattctgtgatatggtttacaacttttaatcataattgnccatgattntggaatgctgtcatttatcagtaaatgtaaaatatttgaggcatttagccatacacacactagaactttttaaaactttgtcctatagtgtaattataaactgatgactattatcttcatgcattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagc

SEQ ID NO: 38632 - DNA, 486 bp, Homo sapiens
gggctcccctaacgtatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaacgttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaacgctccatttgcagctctagccaagtagatacttggtaggtatagag

SEQ ID NO: 38633 - DNA, 186 bp, Homo sapiens
  misc_feature 3: n = A,T,C or G
gtngtaccataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgt

SEQ ID NO: 38634 - DNA, 228 bp, Homo sapiens
  misc_feature 17: n = A,T,C or G
tatggccgggattcttnagttgtgcaaatacacttggctttgatttcacttggtgatctaaatttgtttatttaagctgcaagaaagttacattaatttggaatgtgtcatcacttggacccagtatatcagatttttattgagtaaaatgttaaaaataataagtgtaactcagattctggatgttcagagtttacaatacattgcctgtaataaaagctgattctg

SEQ ID NO: 38635 - DNA, 491 bp, Homo sapiens
tatggccgggagttgactgtttggaagatgtttgtcatcagtcactagagagtgaccagtcagtacaaaagcattccctactagaaaaatagctgtgtccacagccttctggtgaggggttggttgcctggcttcagtctatttcaaaagtcagtgcatataaattgaatattaagtcatatggtgtatatggcacttaaacatcacttcctaacaggtaaaaacccagctttctctgctttgtgaatagtgtatacatatttctttcagagccagtttttagtctttttgccttcaccaacaaaattacttctgtgcacagtagaattatttggtcttgtgattggagtcctgacagcaagtatttcttcactgggagtcgagacaaaaaggtagttgtctggggtgagtgcgactccactgatgactgtattgagcacaacattggcccctgctccccagtcctggacgtgggtggggctgtgacagct

SEQ ID NO: 38636 - DNA, 178 bp, Homo sapiens
tatggccgggcatatccgttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggatc

SEQ ID NO: 38637 - DNA, 460 bp, Homo sapiens
  misc_feature 24, 51, 204: n = A,T,C or G
gatgtttcattttatgaatggagnttctttactaggtctagaatatttttntaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccntatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtat

SEQ ID NO: 38638 - DNA, 173 bp, Homo sapiens
  misc_feature 16: n = A,T,C or G
caagtttaaaatgttnggatggtttgttgttctgcctggagacaaggtgctaacatagatttaagtgaatacattaacggggctaaaaatgaaaattctaacccaagacatgacattcttagctgtaacttaactattaaggccttttccacacgcattaatagtcccatttt

SEQ ID NO: 38639 - DNA, 439 bp, Homo sapiens
ggggctcggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgctgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgc

SEQ ID NO: 38640 - DNA, 266 bp, Homo sapiens
  misc_feature 3: n = A,T,C or G
ctnctccctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 38641 - DNA, 470 bp, Homo sapiens
tatggccgggcgctcctttggaaataataaatatccacaaaatagtgatgatgaagaaaatgaaccacagtattgaaaaagaggaaatggagcttagtttggtgatgtcccagagatgggacagcacatatgtgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattggaacaatgaaaattctagaacccactcttctgtaattgcaacaagcaagctttcagttaaaccctccatctttcacaaagatgctgctacattagaaccctcatcttctgctaagattacctttcagtgtaagcacacaagtgccctttcttcccatgtt

SEQ ID NO: 38642 - DNA, 167 bp, Homo sapiens
aattgcccaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacag

SEQ ID NO: 38643 - DNA, 243 bp, Homo sapiens
gaacggcctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaagc

SEQ ID NO: 38644 - DNA, 491 bp, Homo sapiens
  misc_feature 36: n = A,T,C or G
agaaaatcaagtgaagtttagtttaaaatgcattgnttaagcaagtaattgtagatgaccttaaactaatccattgaaggctataagaaagagtttgattttagtgtaaataaaattccttaattagaaaggcaattaaactgtttcatgatcaagctcttattcctaaagagaggattttagattaaataaatcaaacagaagtaagccctcacatcttctctatctcgcttgggtaatgatggagttcaaagtcacagagccccatttctacaacataaacaaagtaaaaattggttcataaaatagaatgatgtagttgtggtttagggactattttttatttattggaattgcattttgagatccaaagctgcttattgaatttccatatgaggagagtttgtgtgaggacccagcaacagacaagctgttttccagaaaaagctactcacatcaaattaatatccggtttctttaaaattgcagga

SEQ ID NO: 38645 - DNA, 269 bp, Homo sapiens
gatacaacggaaacaggtcctgctggcttaatttaaacagttattgcatgaagtagcgtggaggccctggactgctgctcgttctttaggatggactgttctggtaactggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaac

SEQ ID NO: 38646 - DNA, 277 bp, Homo sapiens
  misc_feature 208: n = A,T,C or G
cagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggngaccttacattttggaaacaacatattacgtataaattttgaagaattggaataaaattgattcatttt

SEQ ID NO: 38647 - DNA, 182 bp, Homo sapiens
  misc_feature 6: n = A,T,C or G
gaagancctggattggtatttattttttctaattcaggtataggcctctatggactgagtcacgcaccacccccattacattactgaggactataattcatgttctgtctcacattctctaagtgatctttataaccctttaatacatttttcttccaaactgaggttagctggaaaaattt

SEQ ID NO: 38648 - DNA, 288 bp, Homo sapiens
  misc_feature 257, 271: n = A,T,C or G
ggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttanatgcacttttttgngtgttctttaaataaat

SEQ ID NO: 38649 - DNA, 291 bp, Homo sapiens
atgaaaagctcttccgtggcgatcctaaaagctgagtcagagcagtaccatgtaacaccccagggttaagccagcaggaagacctcaaagcaggtgctatttctttgagtgtacaatcttttctttctatttgattctatcatttccaaacccaaaccaccaaagacttcttgccagtcgtgctgactcatgcctgtgatcccagcactttgggagactgaggagggcagatcacttgagatcaggagtttgagaccagcctggccaacatggcggaactctgtctctaca

SEQ ID NO: 38650 - DNA, 488 bp, Homo sapiens
ggacctcttccgagttggctgcagatttgtggtgcgttctgagccgtctgtcctgcgccaagatgcttcaaagtattattaaaaacgtatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcag

SEQ ID NO: 38651 - DNA, 139 bp, Homo sapiens
  misc_feature 24, 139: n = A,T,C or G
acccttcctccctcagcctgcacnctctatcctggaacctgtcctccctttctccccaactatgcatctgttgtctgctcctctgcaaaggccagccagcttgggagcagcagagaaataaacagcatttctgatgccn

SEQ ID NO: 38652 - DNA, 237 bp, Homo sapiens
cttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttg

SEQ ID NO: 38653 - DNA, 240 bp, Homo sapiens
gagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacataca

SEQ ID NO: 38654 - DNA, 442 bp, Homo sapiens
aactattggccgcctgcaggatgagattcagattatgaaggaggaaatggctcatcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttg

SEQ ID NO: 38655 - DNA, 343 bp, Homo sapiens
  misc_feature 31, 32: n = A,T,C or G
catttaagaaattgaaataaaaatctgtttnnctgtaaatcaattagtatgacctataggcccagatggttttacaggaaagttttctcagacatttaaagaacagatacacacattcttccagagcatagaaaaagaagaaagatgctttccaactcattttgaggttattttcacctcgatgccaaaaatcaaaatgtcacaaaatctgcccttcaagctaaatgtcatcattttctttttagaatttttcattgttctcttattcatacctcaacattcctaaaagtgtgctttggccaacttagtcctgcaagatgctccatgacagagaattctgtag

SEQ ID NO: 38656 - DNA, 336 bp, Homo sapiens
  misc_feature 18, 44: n = A,T,C or G
ccattttcatttgtgtgncaatttttaatataaatgcggagacntaaagcattaatgcaagttaaaatgtttcagtgaacaagcttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatac

SEQ ID NO: 38657 - DNA, 418 bp, Homo sapiens
  misc_feature 6: n = A,T,C or G
aactcnccttttcctatttgaatttctttggtgctgtagaaaacaaaaaaagaaaaatctatattcataaaaaatatggtgctcattctcatccatccaggatgtactaaaacagtgtgtttaataaattgtaattattttgtgtacaggtctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacac

SEQ ID NO: 38658 - DNA, 274 bp, Homo sapiens
actgggtctctattttaccctcctacaagcctcagagtacttcgagtctcccttcaccacttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatga

SEQ ID NO: 38659 - DNA, 332 bp, Homo sapiens
acatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgactttctcagtttcccaccagcctccctacagaagatgataccaagatagcactacatctaaaagataatg

SEQ ID NO: 38660 - DNA, 220 bp, Homo sapiens
  misc_feature 32: n = A,T,C or G
gaacacacacaaaaatattcttaagggctcantatttagcaaacacagaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgcca

SEQ ID NO: 38661 - DNA, 467 bp, Homo sapiens
  misc_feature 32, 426: n = A,T,C or G
tgtgcctctcattgtgatgagcgtgttctggngcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgtagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggngaattacgtgcctccataacctgaactgtgccgactccaca

SEQ ID NO: 38662 - DNA, 396 bp, Homo sapiens
  misc_feature 33, 34: n = A,T,C or G
catggctctggtgggagtgtagcagtgagggcnnccagaggtcactctcatcaccatcttggttttggtgggttttggctggcttctgtactgcaagctgttttatcagcaaggtctttatgacctgtatcttgtgctgacctcccatctcatcctgtgactgacaatgccttaactgtctgagaatgcagcccagtaggtttcagctttattttacatagcccctattcaagatggagttgctctgcttcaaacatctctgacagttccatacaggcaggcttggaattgatagactgaggataatttaagaaactgagtagtgcagtagctcatgacagaagtgtttaagatctgagcaataggatacagctcataactatttagaaaaagtac

SEQ ID NO: 38663 - DNA, 485 bp, Homo sapiens
  misc_feature 32, 441: n = A,T,C or G
agacagtccacttaaatgcagctccagggttncgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggngggttggcactctgacaccgagctcggtcttcctgtcctggggt

SEQ ID NO: 38664 - DNA, 120 bp, Homo sapiens
  misc_feature 31: n = A,T,C or G
ttcaagcaacatatgtaataagctatcctgnttgtgctgcttcataattgagatacatttccatgtgatttctgtctatctgggtacatgataaaaatttttaaaaggacagtctgtttt

SEQ ID NO: 38665 - DNA, 363 bp, Homo sapiens
  misc_feature 28, 233: n = A,T,C or G
tcccctgctgatacacaggcaaacagtntttggagtggacctccagcaaactccaacagacctgcagctgagggtcctgactgttagaaggaaaactaacaaacagaaaggacatccacaccaaaatcccatttgtacatcaccatcatcaaagaccaaagatagataaaaccacaaagatggggaaaaagcagagcagaaaaactgaaaattagaaaaatcagagcagagcncctctcccccgccaaaggaacacagcttctcgccagcaacggaacaaagctggacagagaatgactttgatgagttgagagaagaaggcttcagacgatcagacttctccgagctaaaggaggaagttcg

SEQ ID NO: 38666 - DNA, 467 bp, Homo sapiens
  misc_feature 30, 31: n = A,T,C or G
taggcgcctctctccctactgctgctacanntgtaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctt

SEQ ID NO: 38667 - DNA, 289 bp, Homo sapiens
agctttcctcatattgagagctctgctatgccttgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacattgttacaaaggcaactaccatgttaataaaatattcaatttg

SEQ ID NO: 38668 - DNA, 395 bp, Homo sapiens
  misc_feature 337: n = A,T,C or G
gacagaccagagctgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgnatatgtgagatgtttaaataaattgggaaaaaaaatgaaataaagcctgtttgggttt

SEQ ID NO: 38669 - DNA, 149 bp, Homo sapiens
tagccgggcatggtggcgggcgcctgtaatcccagctattcatgaggctgaggcaggagaatcgcttgagccggggaggcggaggttgtagtgagctgagatcgcaccactgcactctagcctgggcgaaggagcgagactccatccca

SEQ ID NO: 38670 - DNA, 336 bp, Homo sapiens
tgctgtgagtgtctttagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaataccaaaaat

SEQ ID NO: 38671 - DNA, 445 bp, Homo sapiens
  misc_feature 7, 32, 321: n = A,T,C or G
agtcccncagaaaataaatatttgatcctgtnataaaccatttgaatgtctacatatgaacccaggccatataaaaataaccaattcaagataacataggaagtcactaaaaaagacacaaataaaattagatttcacagtttacgctgatattttgatacttttctgtgataaaagcatcttccaaactaaatgtgtccatatttgaaccatgtaaatagttaaaagtattttacctgagaatatctaaatgatgccaagaaaataagttcatgccactaaaaagattgagatgatttgtgctttatctgacttcttggngtaatatggatttacttcagataagtatattttctacttatccgataagtgtgtttatctgagataaatattttctccagatacgtgtgtatattgaaaaaaaatttaaaataattaggatccc

SEQ ID NO: 38672 - DNA, 201 bp, Homo sapiens
  misc_feature 3: n = A,T,C or G
ganccaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcccgaaccatccaggccaaataagc

SEQ ID NO: 38673 - DNA, 355 bp, Homo sapiens
aaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgttt

SEQ ID NO: 38674 - DNA, 167 bp, Homo sapiens
accaagaaaattgaaaaacttggctggcatggtggtgtgtgcctgtagttccagctatttgggaggctgaggtgggaggatcgcttgagcctggaggatcaaggctgcagttagctatgatcatgccactgcactccagcctgggcaacagagtgagaccttttctc

SEQ ID NO: 38675 - DNA, 481 bp, Homo sapiens
  misc_feature 8, 36, 61, 214, 219: n = A,T,C or G
aaagtgcncatctatttttttaagggtgaaagtatntatgagtacttaggagaggaataanacaacacgtattggattctatggtgccaagcttgatttgcctctggcttggccattccaagaagagcttaagctttttcatcttaactctgatgcacaatcttaatttaaactgtatgagatttgccctgatgcacaccagtttcatccgttnctggnatcaacaaaatcaaagcatctaactttttcaaacacaaagggatgaattgtgaatacctgctgaatttccacaagtcaacaacctaacaaaaccacaaaaaaagacgaggtaactttttttcttaagtgaaaagtagcctaacactagaaaagagaacatttatttctgttttcatccgtttctggtatcaacaaaatcaaagcatctaactttttcaaacacaaagggatgaattgtgaatacctgctgaatttccacaag

SEQ ID NO: 38676 - DNA, 292 bp, Homo sapiens
  misc_feature 58: n = A,T,C or G
ttttcggaaacatttctggctttcataatttttgtaaaagttattagcttagtttgcngtaaatgaataaaattattagtcatctcgtttttgtcagtatagtttttttacgactgcaccttaccctagttaaacagcagataaagccaactttatgtattaaatttaaagactcagtctgagtctttagagtctttaaagacttgcccagccttctgaactccaagcattattcactcagaaaattttctcgtaactttttttagcttatggaacttagcttttttacttc

SEQ ID NO: 38677 - DNA, 465 bp, Homo sapiens
  misc_feature 58: n = A,T,C or G
cgcaccagatatagtaccgcaagggaaagttttaaaattataaccaagcataatatancaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 38678 - DNA, 424 bp, Homo sapiens
  misc_feature 33, 34, 60, 251, 265, 269, 306, 337, 349, 396: n = A,T,C or G
gtatgtccactggactcagctcaacatgttctnntaccttgaagtacctggccatcttgngcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagatngtagttatactttngctngtttttcagtttccccaacacacagcagatacctggngagctcagatagtctctttctctgacactgngtaagaagctgngaatattcctaacttacccagatgttgcttttgaaaagttgaaatgngtaattgttttggaataaagagggtaac

SEQ ID NO: 38679 - DNA, 374 bp, Homo sapiens
ccaggtggcctggaggtgggcacagggaagtaacagacacacgatgttgtcaaggatggttttgggactagaggctcagtggtgggagagatccctgcagaacccaccaaccagaacgtggtttgcctgaggctgtaacttgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggac

SEQ ID NO: 38680 - DNA, 342 bp, Homo sapiens
  misc_feature 182: n = A,T,C or G
gagggggcaggcggagcttgaggaaaccgcagataagtttttttctctttgaaagatagagattaatacaactacttaaaaaatatagtcaataggttactaagatattgcttagcgttaagtttttaacgtaattttaatggcttaagattttaagagaaaatatgaagacttagaagagnagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatg

SEQ ID NO: 38681 - DNA, 312 bp, Homo sapiens
aacatgcctctcgcaaaggatctccttcatccctctccagaagaggagaagaggaaacacaagaagaaacgcctggtgcagagccccaattcctacttcatggatgtggaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 38682 - DNA, 169 bp, Homo sapiens
  misc_feature 157: n = A,T,C or G
gaggcccagctcgggagccaagcagattccaaaccactacaacccttgccaaacacagcccactccatttcagaccgccttcctgaggagaaaatgcagacgaagggttccagtaaccagtgatggattcaccccatctcccgaataaagtttactntgttttacattc

SEQ ID NO: 38683 - DNA, 432 bp, Homo sapiens
  misc_feature 13, 33, 35: n = A,T,C or G
gacaaccctagcnaaacctttacccaaatattntntaggcgatagaaattgaaacctggcgcaatagatatagtaccgcaagggaaagatgaaaaattataaccaagcataatatagcaaggactaacccctataccttctgcataatgaattaactaggaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttg

SEQ ID NO: 38684 - DNA, 209 bp, Homo sapiens
actagtcacagccaacactaccctatggaaacattgtcctcttttcttctgtgcctgaactcccaaattaatttctagtttgaaaatattctgaccgggtgcagtggctcacacctgtaatccacacactttgagagactgagatggggggatcactttgaggccaggagttcgagaccagcctgggcaacgagagcgaaactctgtct

SEQ ID NO: 38685 - DNA, 342 bp, Homo sapiens
  misc_feature 25, 181: n = A,T,C or G
tataatagtagaagaaattccagcnagcaatgtaatcctctttcttaaatgtaattgtacaactaacagtcatcacacatatgagggtagccagcaacgtgagagacaaaattcaagattaagttccaaaatcaacatggaggacaatttagtaaagagactagacctcttttataaaatnataattactatgtagcagaaaggagccaggacaagaatgaataaacagattacaaatattgttgctgaaataaaaatgttcaataggaggattaaagtccaaaaagaaaacttccccaatacaaaaagagatagaagacatagagaaccaattcagactat

SEQ ID NO: 38686 - DNA, 375 bp, Homo sapiens
  misc_feature 8, 15, 31, 32, 58: n = A,T,C or G
ctactacnccatgtnatttaacacaccattnnttttcaaaactaaaatatgggctaanctcacagcattttgtctttaaagaatataatatattaaataagatcgtaagccagtgtatttggaattggaaaagggaatctggaacttagatcaaatcactttaaaggaaattggccaaactaataatgtctgttaaaatgaccatatgaatgaatgcgtacacgcacacacacctgcttctgtagatttgacctgtaccaatgtgtggggaaaaactaattaaattgacgtcattatgaatatgagtttagaaactgtgtacaatgaatttaaataaagttttatgttatatgttcatggacttacatcatagtt

SEQ ID NO: 38687 - DNA, 480 bp, Homo sapiens
  misc_feature 17, 23, 84, 461: n = A,T,C or G
catgttcatcaagctgngatttncttttcttttttttaattattattatactttaagttttagggtacatgtgcacaatgtgcnggttagttacatatgtatacatgtgccatgctggtgcaccgtacccactaactcgtcatctagcattaggtatatctcccaatgctatcccttccccctccccctaacccacaacactccccagagtgtgatgatctagaactagaaataccatttgacccagccatcccattactgggtatatgcccaaaggactataaatcatgctgctataaagacacatgcacacatatgtttgctgcggatttgttcacaatagcaaagacttggaaccaacccaaatgtccaacaatgatggactggattaagaaaatgtggcacatatacaccatggaatactatgcagccataaaaaatgatgagttcatgtcctttgnagggacatggatgaaattg

SEQ ID NO: 38688 - DNA, 181 bp, Homo sapiens
  misc_feature 26, 101, 180: n = A,T,C or G
gtcccgatgtgtccagccagctccgnagcagcttttcaaaatgcactatgcctgattgctgatcgtgttttaactttttcttttcctgtttttattttggnattaagtcgttgcctttatttgtaaagctgttataaatatatattatataaatatattaaaaaggaaaatgttgggggng

SEQ ID NO: 38689 - DNA, 476 bp, Homo sapiens
  misc_feature 7, 31, 32: n = A,T,C or G
aatctcncttcttgctgtgacatagcgatgnntttgagtggatctagggcaagtgatcaatgtaatgcatcttgacttcattaaacctctacaatgctgtgatcaacagttgggaaggtgagtttggggccagacatctgtgttggactacccatcagaccaccttcaggaaagggacggcaggttgaaacttgttagtagcaacttaaaatctcccttttttatgggagagcttttttaaggtttgcaggtagcaggatcctgatgggattcagagaaagccaagaagacggattggagaagttgtcagtcctagatagaatagcatccttccattgaggtcaacataggtccggttcttattagagcccctgtgctgtttaggtcttctggtcaacaagggaagtggagaaattggaaaagctcaggaattggaccacaaatcattagaggcacaaaaatagaacttagaaaat

SEQ ID NO: 38690 - DNA, 121 bp, Homo sapiens
gcttcaagaatgaagctgaacatctccttcccagccactggctgccagaaactcattgaagtggacgatgaacgcaaacttcgtactttctatgagaagcgtatggccacagaagttgctg

SEQ ID NO: 38691 - DNA, 156 bp, Homo sapiens
  misc_feature 27, 153, 155: n = A,T,C or G
aaacaaaagagttaaaattgcataccngttggctgggcgcaatggctcatgcctgtaatcccagcagtttgggaggccgaggtgggtggatcacgaggtcaaaggatcaagaccatcctggccaacatggtgaaatcccatctctattaaaantnc

SEQ ID NO: 38692 - DNA, 365 bp, Homo sapiens
  misc_feature 175, 176, 177: n = A,T,C or G
gtggtgcgttctgagccgtccgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggcnnngaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttactttcatggcatgaataaatggatctgtgagatgcactg

SEQ ID NO: 38693 - DNA, 178 bp, Homo sapiens
aaactagttttgaggcgtttttatcgatgtttaaagatgaaaaacgcagccaggcacggtggctcaggcctgtaatcccagcactttgggaggcagaggcgggtggatcacttgaggttaggagttcaagaacagcctggccaacatggtaaaaccctgtctctactaaaaatgcggg

SEQ ID NO: 38694 - DNA, 378 bp, Homo sapiens
  misc_feature 8, 36, 62: n = A,T,C or G
aaagcatnccttctgaagagtttcagaagatgcttnttggtaaaaaagaaaagaaaagaaangaaaagcaatgaagtctaccagcaacagacattgaatcaaaattaaatagattagactattacagtctatttccagtaatagaagatgtatatttattgtgaagaagatatgaacgtatcttcaattgacccacaattgaaaaaacatatggataattatcagggaagtttttgagtgaaggtcgattgactgactagcttcaagtcagttattttcatcttaacatgaacctcttgattggtcactaatcaatcaggttccaaattatcttttctttagcacataattgctagaaatattgtaatatatctaatg

SEQ ID NO: 38695 - DNA, 285 bp, Homo sapiens
  misc_feature 55, 148, 151, 155: n = A,T,C or G
tctgcactgaatggctgacctgacctgatgtccattcatcccaccctctcacagntcggacttttctcccctctctttctaagagacctgaactgggcagactgcaaaataaaatctcggagttctatttatttattgtcttcctgtnagngggngggggtcaaggcagaggcaggaaactaactggtgtgagtcaaatgccccctgagtgactgcccccagcccaggccagaagacctcccttcaggtgccgggcgcaggaactgtgtgtgtcctacacaatgg

SEQ ID NO: 38696 - DNA, 117 bp, Homo sapiens
  misc_feature 23, 25, 117: n = A,T,C or G
agtatctgttcttatcagtttancnatctgatacgtcctctatccgaggacaatatattaaatggatttttggagcagggagatggaataggagcttgctccgtccactccacacan

SEQ ID NO: 38697 - DNA, 337 bp, Homo sapiens
  misc_feature 20, 175, 179, 184, 316: n = A,T,C or G
tgcacggcccagcttccttnaaaacgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgnggangaggncaccattgtcaacattttgaccaaccgcagcaatgcacagagacaggatattgccttcgcctaccagagaaggaccaaaaaggaacttgcatcagcactgaagtcagccttatctggccacctggagacggngattttggggcctattgaaga

SEQ ID NO: 38698 - DNA, 313 bp, Homo sapiens
  misc_feature 22, 59, 120: n = A,T,C or G
gctgtcccgattatgagagttnctgtgcatgaagtgcataatcccacatcaccaccatnttcaaagaaagcacctccaccttcaggagcatctcaaaccatcaaatcaacaaccaaacgntcacccaaaccaccaaacaagaagaagactaagaaagttatagaatcacgaggaaataacagaagaacattctgtttctgaaaatcaagagtcctcctcctcctcctcctcttcctcttcttcttcaacaattcggaaaatcaagtcttccaaaaattcagctgctaatagagaattacagaagaaactcaag

SEQ ID NO: 38699 - DNA, 197 bp, Homo sapiens
cgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgtt

SEQ ID NO: 38700 - DNA, 298 bp, Homo sapiens
  misc_feature 176, 177: n = A,T,C or G
gaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccnnaaattggcctattccttcaattaataaaatatttttgccatagtatgtgactctacataacatactgaaactatttatattttcttttttaaggatatttagaaattttgtgtattatatg

SEQ ID NO: 38701 - DNA, 398 bp, Homo sapiens
  misc_feature 154, 155, 333, 368, 392: n = A,T,C or G
gactgcccaaggatgatccaatgatatttgattcttcctgatgatgttggagtatgggatctgtaatgagtttcaagttagtcttaaatgtatatatttattctctaatccatgtcaagaatttaaggtattctaccacagtgtagaactcaannggactagtagcttattggatcaagaaagactgaaacaagttaattaaatgtctgtttttttccatctaaaatttatcaggcacatagtaagtattatattacagtacctgttagtgttgtcaaaggcaagacagattcagtatctataacatcagatgcctggataaagccatgtggngaaggaacgataagtattgtttcatcatcaattgnttgatcaacttgttcttctatagngggaga

SEQ ID NO: 38702 - DNA, 393 bp, Homo sapiens
  misc_feature 19, 25, 176, 237, 270, 388: n = A,T,C or G
gcactacatagtcagatanatggcnggagtaagcacaaactggaaaacatactgaaacccatttgcatttcttctggcatcagggaacccttgctttccctaataattcagaaccaggaaatccatgttcaggcctaagcttaaattaaatggcagttgcttagggaagagttccngagatacggttaaatcttccttttatatactcccccagcactgtgtacttttttccactgnaaacactcatcacaactgtaaataagtaattgnttggataatccttttctatcttcccccactaaactgtacacaccataaggggaggggccctgtctgtcatcttcacattggagtcccaactcattgtatgttcagaacctggcatagngcctg

SEQ ID NO: 38703 - DNA, 100 bp, Homo sapiens
  misc_feature 8, 29, 31, 36, 42, 75, 89: n = A,T,C or G
cacaaganccacataataaattccacttntngaccngaattnggaaatccgaaattactaatccaggccaggggngggggctcatgccngtaatcccagc

SEQ ID NO: 38704 - DNA, 223 bp, Homo sapiens
  misc_feature 4, 6, 159: n = A,T,C or G
gtancnggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatngtgattggtaccctgactgcactacagtggtttatctatgactccgtgaaggtctacttcagac

SEQ ID NO: 38705 - DNA, 330 bp, Homo sapiens
catgattggcatgttttgctgacccaatcactaacttctcaaattttctttaatacaaagtaaagcacttaccacttaatggtaagtgctattttagcattaactatttaaaactaaaaatataagatacttatgtcacttgaagtgataccaatctaatttgtcctgatataccataattgctttcaccaaaggacagaaaacaatggattttagaaaagtcactcagaaaaatatttagccaagtaggccaaagaattaccctcttttctcagcatgctttgaaaattggaatttcacactaaattccagtgaaaaagctatgcttct

SEQ ID NO: 38706 - DNA, 395 bp, Homo sapiens
taatattcatacattatttttgccttttgattgtttttaaattgtttaactttggctcttgtcatgctggatcttgtgttcctttgattcaacgctatcccttttttttattattaagcacttcttgactactatcttgtactataagatgcttcaggttcatcttatattttttatatttttcttgtcccagccctagcatcagaccttttcccagggagtcatgttttttttaattagagagctatatttagaaagcaaggtttggtcaggggacattatggatttttatatattaatcatgtaatcatgtcattaatcatgtaatcatgtaacaaattccattatggtaatttgtttgttgattcccttggggtttcagcatagaagcaaga

SEQ ID NO: 38707 - DNA, 243 bp, Homo sapiens
  misc_feature 24, 25: n = A,T,C or G
gaggctgaggcaggcagatcacgnngtcaggagatcgagaccatcctggctaacatggtgaaacccctgtctctactaaaaatacaaaaagaaattagctgggcgtggggacgggcgcctgtagtcccagctactcgggaggccgaggcaggagaatggtgtgaacccaggaggtggagcttgcagtgagccgagatcacaccactgcactccagcctgggcgacagagcaagactccgtcgc

SEQ ID NO: 38708 - DNA, 207 bp, Homo sapiens
  misc_feature 24, 25, 179: n = A,T,C or G
agcaagatttttagtaagaaattnncaagctaatctcaaatgtatatggaaatgcaaaataactacaataatctaaacaattttgaaaagcaagaccaaaattggaagacttaatctacttgatttcagaacttactatacagtgagagtagtcctaacagtgtgctactgatgctacnagatagacagatggatttgtgtaataac

SEQ ID NO: 38709 - DNA, 291 bp, Homo sapiens
  misc_feature 27, 154, 180, 265, 275: n = A,T,C or G
aggaagaaagatgaggcagaggtcccngtaaaccgctagcttgttgcaccgtggaggccacaggagcagaaacatggaatgccagacgctggggatgctggtacaagttgtgggactgcatgctactgtctagagcttgtctcaatggatctanaacttcatcgccctctgatcgccgancacctctgagacccaccttgctcataaacaaaatgcccatgttggtcctctgccctggacctgtgacattctggactatttctgngtttatttgnggccgagtgtaacaac

SEQ ID NO: 38710 - DNA, 232 bp, Homo sapiens
  misc_feature 23, 24, 182: n = A,T,C or G
gcaggtggatcatttgagcccannagtttgacaacaacctgggcaatatagtgaggcccccatctctacagaaaatacagaaacattagccagcatgcatcgtggtgtgcacctatagtcccagctacttgtgaggcagaggtgagaggatcacatgagcccagggagatcaagtctgcagngagccgtgatcatgccaatgcaccccagcctgggaagtagagcaagacct

SEQ ID NO: 38711 - DNA, 666 bp, Homo sapiens
  misc_feature 4: n = A,T,C or G
atcnagggctccaatgacgtggagatccgggcagagggcaatagcaggttcacgtacactgccctgaaggatggctgcacgaaacataccggtaagtggggcaagactgttatcgagtaccggtctcagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaraagattattggaaag

SEQ ID NO: 38712 - DNA, 535 bp, Homo sapiens
ctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 38713 - DNA, 318 bp, Homo sapiens
gaaggctctagaaaaggggcgcattgcgatccaaccatcggcagccgattccgtgtcttgatcacggggtgggagggaaccgtggcgtccytgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcct

SEQ ID NO: 38714 - DNA, 577 bp, Homo sapiens
  misc_feature 30: n = A,T,C or G
aagggtttcagtatgttggccaggctggtntcaagctcctgacctcaggacatccacccaactcggcctcccaaagtactggtattaagggcatgagccaccgtgctgtgcctaaatgtggctagttcttagccttaacaaagcatctgacaggtcaggacctgatttctgcctcaattttagagacttgttctaaaggaaaaaaacacacatttgagtttttaatacatgtcagatactcaccttggaatgcaaaaacaaaatccatctagcctactcaactaaaaatgagtaagaaggccaggcgcrgtggytcaygcctgtaatcccagcastttgggaggccgaggcrggckgatcacctgaggtcrggagytcragaccagcctgacaaacatggagaatccccaactctactaaaaatataaaattaaccgggtgtggtggtgcatgcctataatcccagctactcgggaggctgaggcaggagaatcacttgaacccaggaggcagaggttgcagcaagcaaagatcgcaccattgcactccagcccaggcgacagcccaagactccgtc

SEQ ID NO: 38715 - DNA, 459 bp, Homo sapiens
  misc_feature 9: n = A,T,C or G
cgcaatagnatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccc

SEQ ID NO: 38716 - DNA, 433 bp, Homo sapiens
ggccgggrctcttccggggacgttgtctgcaggcactcakaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttycatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaaga

SEQ ID NO: 38717 - DNA, 556 bp, Homo sapiens
  misc_feature 555: n = A,T,C or G
catgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattctygcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaang

SEQ ID NO: 38718 - DNA, 348 bp, Homo sapiens
agcttaatagtagtagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgaraccctgtctctacwaaaaatacaagaattagtcaggcgtggtggcatgtgcctgtaatcccagctactcgggaggctgaggcaggagaatcgcttgaacctgggaggtggaggttgcagtgagccgagatcacgccgctgcactctagcctgggtgatagaac

SEQ ID NO: 38719 - DNA, 355 bp, Homo sapiens
agaacctccaatactgccatgagaaactagagggcaggtcttcataaaagccctttgaacccccttcctgccctgtgttaggagatagggatattggcccctcactgcagctgccagcacttggtcagtcactctcagccatagcactttgttcacygtcctgtgtcagagcactgagctccacccttttctgagagttatttacagccagaaagtgtgggctgaagatggttggtttcatgtttttgtattatgtayctttttgtatggtaaagactatattttgtacttaaccagatatatttttaccccagatggggatattctttgtaaaaaatgaaaataaagttttttt

SEQ ID NO: 38720 - DNA, 449 bp, Homo sapiens
cggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattatt

SEQ ID NO: 38721 - DNA, 585 bp, Homo sapiens
  misc_feature 23: n = A,T,C or G
tgaggctgtaactgagagaagantctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgtaaaataggaaaaagtgggagttgggtgaatccggttgttctttcctcacatttggatgattgtcataaggtttttagcatgttcctccttttcttcaccctccccttttttcttctattaatcaagagaaacttcaaagttaatgggatggtccggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 38722 - DNA, 474 bp, Homo sapiens
  misc_feature 378, 418: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgnaaggtgacttaaacagcttaaagtttagtttaaaagttgnaggtgattaaaataatttggaaggcgatcttttaaaaagagattaaaccgaaggtg

SEQ ID NO: 38723 - DNA, 224 bp, Homo sapiens
taggaattcgagtaccgcctgaccaacatggtgaaactctgtctctactaaaaaatataaaaaaaattagcwggkgatggtggyrggtkcctgwartcccagctacttgggaggctgaggcaggagaatcactyraacccaggaggcggaggttrcagtsagctgagaycgcaccattgcactccagcctgggyracaragcaagaytccrtccmwaaaaaaag

SEQ ID NO: 38724 - DNA, 630 bp, Homo sapiens
atgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagakatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaat

SEQ ID NO: 38725 - DNA, 468 bp, Homo sapiens
cggccggaaccgccatcttccagtaattcgccaaaatgacgaacacaaagggaaagaggrgaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagccygctccacccagagaagcacactttgtgagaaccaatg

SEQ ID NO: 38726 - DNA, 275 bp, Homo sapiens
cgcrgtggctcawgcctgtaatcccagmactttgkgaggccgaggcrggygratcacgaggtcaggagatcgagaccatcytsgctaayrcggtgaaaccccgtctctmcyaaaaatacaaaaaaaataagccaagcgtggtggtgggcacctgtagtcccagctactcaggaggctgaggcaggagaatggcgtgaactcagaaggtggagcttgcagtgagctgagaccgtgccactgcactccagcctgggcgacagagcgagactccgcct

SEQ ID NO: 38727 - DNA, 287 bp, Homo sapiens
  misc_feature 10, 21, 22: n = A,T,C or G
aactgaggcnatgattaaganngacggccgggggcattcgtattgcgccgctagaggtgaaattcttggaccggcgcaagacggaccagagcgaaagcatttgccaagaatgttttcattaatcaggaacgaaagtcggaggttcgaagacgatcatgataccgtcgtagttccgaccataaacgatgccgaccggcgatgcggcggcgttattcccatgacccgccgggcagcttccgggaaaccaaagtctttgggttccggggggaagtatggttgcaaagctg

SEQ ID NO: 38728 - DNA, 462 bp, Homo sapiens
  misc_feature 407: n = A,T,C or G
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtangcctaaaagcagccaccaattaagaaagcgttcaagctcaacacccactacctga

SEQ ID NO: 38729 - DNA, 708 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccratctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactc

SEQ ID NO: 38730 - DNA, 504 bp, Homo sapiens
  misc_feature 2, 20, 60, 66: n = A,T,C or G
cnccccgggacctcggcccntctggccgggggrgcmtttaagamgcatcctctgccaagnaccaanaggaaagaagamaaagggccaaaagccaaawkraaactgatggtacttgttttcaccmttgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagacgywtagattctat

SEQ ID NO: 38731 - DNA, 294 bp, Homo sapiens
agagaaaacagctccttggtgaattgataagtaaaggcagaaaasattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 38732 - DNA, 336 bp, Homo sapiens
atccccgttccgtgagtyaccctctaaatcaccacgattaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacat

SEQ ID NO: 38733 - DNA, 474 bp, Homo sapiens
ggsattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgata

SEQ ID NO: 38734 - DNA, 244 bp, Homo sapiens
agagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttk

SEQ ID NO: 38735 - DNA, 165 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 38736 - DNA, 578 bp, Homo sapiens
  misc_feature 558: n = A,T,C or G
tcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagaaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcagkggytcacgcctgtaatcccagcactttgggaggctgaggcgggcggatcacgaggtcaggagtttgagaccagcctcaccaatgtggtgaaaccctgtctctagtaaaaatacaaaaattagctgggcatggtggtgcatgcctgtaatcccagctactcggaaggctgaggcaggagaatcacttgaatccgggaggcagaggttgcagtgagccgagattgtgccacagcactccagcctgggcaatagnagtgggactccatctcaaag

SEQ ID NO: 38737 - DNA, 166 bp, Homo sapiens
  misc_feature 6, 10: n = A,T,C or G
ggcggngacnacccattcgaacgtctgccctatcaactttcgatggtagtcgccgtgcctaccatggtgaccacgggtgacggggaatcagggttcgattccggagagggagcctgagaaacggctaccacatccarggaaggcagcaggcgcgcaaattacccac

SEQ ID NO: 38738 - DNA, 416 bp, Homo sapiens
ggttccctagaaatagagagcccatgttgtgtatcagtgggaatggaaggggaggtcctgtggtagcttgagggtcaggaagccaggccaagaaagccacaaagattggattccaagtagaaggggaagaccaggcgcagtggctcaygcctgtaatcccagcaytttgrgaggccgaggyrggwggatcaccttgaggtcaggagtttgagaccagcytggscaacatggwgaaaccycgtctctaytaaaaatataaaaattaactgggtgaggcagcaggcacctgtaatcccagctacttgggagactaaggtacaagaattgcttgaacccaggaggaagggaggttacagtgaactgagatcatgccactgcactccagcctgggtgacagagcgagactccaactcaag

SEQ ID NO: 38739 - DNA, 419 bp, Homo sapiens
  misc_feature 55: n = A,T,C or G
gatgcattctgagaaaagtgtccttaggcaattttttcttgtgcaaacatcattntatgtacaaatctagatggtagagcctactatacacctagtgtaccagtctgttttcatgcagctgataaagacatacccgacactgggaagaaaagaggtttaattgaacttacacttccacatggctgggaaggcttcagaatcatggcgggaggcgaaaggcccttcttacatggaggaggcaagagaaaatgaggaagaagcaaaggcaagaacccctgataaacccatcagatctcatgaracttattcactatcatgakaatagcacgggaaagaccagccctcatgattcaattacctccccctgggtccctcccacaacatgtgggaattcaggaagatacaattcaagttgagat

SEQ ID NO: 38740 - DNA, 419 bp, Homo sapiens
gaggcattgaggcagccagcgcaggggcttctgctgagggggcaggcggagyttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttgta

SEQ ID NO: 38741 - DNA, 364 bp, Homo sapiens
aggatgcaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaaatatagaagatagaaaaatataaagccaaaaattggataaaatagcactga

SEQ ID NO: 38742 - DNA, 179 bp, Homo sapiens
  misc_feature 3, 8: n = A,T,C or G
ganagccnccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttg

SEQ ID NO: 38743 - DNA, 626 bp, Homo sapiens
  misc_feature 616: n = A,T,C or G
taggagcctctctccctactgctgctacacaagaccctgagactgacctgcaggacgtaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagrggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtattggaaagtgcactgcagtgagggtcaaaggagagtcaacatatggggaattgttccataataaacttctgggggngatacttttc

SEQ ID NO: 38744 - DNA, 635 bp, Homo sapiens
gacagccttccctaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtg

SEQ ID NO: 38745 - DNA, 471 bp, Homo sapiens
  misc_feature 68, 423: n = A,T,C or G
gaggcattgaggcagccagcgcaggggcttctgctgagggggcaggcggagcttgaggaaaccgcagnataagtttttttctcyttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgggaggngattaaaataattttggaaggcgatcttttaaaaaagagattaaaccg

SEQ ID NO: 38746 - DNA, 992 bp, Homo sapiens
  misc_feature 345: n = A,T,C or G
tgctaaaaatgaaaattctaacccaagtacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctsgaggtgggcaaagggaagtaacagwcacacgatgttgtcaaggatggtttngggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttaga

SEQ ID NO: 38747 - DNA, 425 bp, Homo sapiens
  misc_feature 162, 365: n = A,T,C or G
cactagcagatagagttatcctttcttctggctcttgtttccctcccaagacagctacatctcaccatttgccttggcctcctttatttctccttctattcatcttttgtacttggagtggtccgcaaggtgaggagagttgagctcaatgaaaagaagganggtttttgccttttttatgcagaacaatgtcttcaaaaaaatcagaacagaaaaaataagatgcattctaatggatctttgacactttttggtaatgaagcttttagttcccatagagttgtgtgtaggtcaaraaaatctgccaagtttcttactctatgttcagctcaagtttgctctggcaccaaaaraggagaraaacnggggggktgcaaraaaacagggggktgrgagctttatctttttgtcctttactttcatct

SEQ ID NO: 38748 - DNA, 604 bp, Homo sapiens
  misc_feature 597: n = A,T,C or G
cagaggaacaagcatgtctctctgccagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaartgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggggggngattatt

SEQ ID NO: 38749 - DNA, 925 bp, Homo sapiens
  misc_feature 21: n = A,T,C or G
tatcctttgtccagggcttcntaggggacaagcattatggagttattactgaattattacctctgttttactgatgaggaattgaggcttgaaaagttagttttgttttttttcccttaagttcgcacaattctaaaatggcaacgccaggacacaagttgaaatcagactctaaacctgtctcagatctgctgaatcttataaatggtggctcatgatgtaatcccagtacttttggaggcctaggcgggcagatcacctgatgtcaggagttcgagatcagcctggccaacctggcgaaaccccgtctctactaaaaatacaaaaattagccgggcgtggtggcgcacgcccgtaatcccagccactcgggagcctgaggcaggagaattgcttgagcccaggagttcaacaccagcctgggcaacatggtgaaaccttgtctctcaaaaaaataaaaataawaaaaawttatttttttattaacgaataatagagttgatttaataaatcaactctattattctaggcagatttcatagcctaactccccttcaccaaattcagtgctgtatttcatagtgattgactcagaggagaaagatctgtgacttctatcttgctgcatgaccttggggaaaattggcttaaatgtatgaaaggatatttcaggcattgactcagactaaataaatgtgctaaatttgatacagtgagtgggaaatttttctcaccacatggaaccactaatgagcttgggaagtaaacatagttaagtaggcatagttgccttttttgttacaatcattctgaattggtccattagcctgaataacatttcaatgaacttcacatttgtagctttaggattgaccaaaccaaaccgcaacattataaactatttccaggtgagagggttgtagtg

SEQ ID NO: 38750 - DNA, 407 bp, Homo sapiens
attggtgctgtaacatacgcactgtttattgattagttgtgactggtgagaaaattgtagagtctctaaaaaacttaactttaggagcataagtgcattcaaaactaaatccctattgactagcacagcgttaaaaaaaaatagtcgtggcactttgggaggctgaggcaggcagatcatttgaggtcaggagttywagaccagmctggccaacatgrtgaaaccccatctctactaaaaatactgaaaacaaacaaaaacaattagccatgcgtggtgacggacacctgtaatcccagctacaggggagactgaggcaggagaattaaacgtgggaggtagaggttgcagtgggccaagatcacgccactgcaccccatcctgggcaacagcgcgagactccgtct

SEQ ID NO: 38751 - DNA, 528 bp, Homo sapiens
  misc_feature 309: n = A,T,C or G
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctnggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccc

SEQ ID NO: 38752 - DNA, 438 bp, Homo sapiens
  misc_feature 10, 438: n = A,T,C or G
cggccctctnttggcccgggtctggaacctgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttactttggttgtgagatttgtctgttgcttcacacatgaagagtgggagacgttacctaacagaatgttctcttgggttgtcgagaaataattcaggtgaggccaggcacggtggctcatgcctgtaatcccagcagttttggagaccgaggcaggtggatcatttgaggtcaggagttttaagaccagcctggccaacaggggaatcccggtctgtn

SEQ ID NO: 38753 - DNA, 704 bp, Homo sapiens
acaaaaccctcaaggccgggaagacagacttgcagtttccagtcaccccaagctgtgcctggtcaccttgaggatcagtatcccaaaacacttgaacttgcttttgacccaccagttgggaagcggcagcaaattgcaaacttcttgggacaggaatttagacgttgtatctccagggccttgatcaactggctgttaaccacataggtgctcaagaaatgtttgcttactgaagttgtgacaaggcagccatagaaattcattgtgaagttaaatgactttaaggtaggaatatgttagtaactactactaacatagttagttacaaactactctttgtattaaagttggagtactgaagttgctttcttccattgtgtctttcttttaccaaatttcatgttaaagataaagggggaataggccagcrygrtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctc

SEQ ID NO: 38754 - DNA, 553 bp, Homo sapiens
cggccggaaccgcctcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaagggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggct

SEQ ID NO: 38755 - DNA, 559 bp, Homo sapiens
aagtatctcactcaaggtgatacagctaatagtggcacagccaggattcagacctggacgatcctaagtttccatttcctaatctgaaaacagagatagccatactcagctcctaaaagtactaccccctcactgtaactaaatgattcaatgtatgtaaaatgccttatacataacaagtactagaaacgtttgttctgtgttctcttttccttctctttccttcccattcccatttctgattacagggaatttacataactttaaaagtgactattcggccaggcgcagtggbtcacgcctgtaatcccagcactttgggaggccaaggcaggcagatcacgaggtcaggagttcgagaccagcctggccaacatggtgaaaccctgtctctactaaaaaatacaaaaattagccaggcatggtggcacgtgcctatagtcccagctactcaggatgctgaggcaggagaatcgctggaacccaggaggcgggaggttgcggtgagccaagatgctctactgcactccagcctgggtgacagagacagactccatcg

SEQ ID NO: 38756 - DNA, 511 bp, Homo sapiens
  misc_feature 3, 35, 36: n = A,T,C or G
aantctcttctttacagtacaatactacctaagannatgcaggaggagccaggcacgatggttcctgactgtaatcccagcaattcgggaggttgagagatgggagaatcgcttgagcctaggagtttgagactagcctgggcaatatagtgagaccttgtctctacaaaataaatttttaaaaattagctgagtgtggtggcatgcgcctgtaatcccagctacttgggaggctgaggtggcaggatcccttgagcctggggggtcaagcctgcagtaagccaagattgcaacactgtactccagcctgggtgacagagcaagaccktgtctcwgcaaaaaattttttaaaaattagctgagtatagtggcacacacctgtagtcccagctacttgggaggctaaggcaggaggaggatcacgtgagctcaggaatttgaggctgcaatgagttatggtgacaccactgcactccagagtgagaccctgtctccaaaaaacaaacaaaca

SEQ ID NO: 38757 - DNA, 470 bp, Homo sapiens
gsattcctgaagctgacagcattcgggccgagatgtctcgctccgtggccttagctgtgctcgcgctactctctctttctggcctggaggctatccagcgtactccaaagattcaggtttactcacgtcatccrgcagagaatggaargtcaaatttcctgaattgctatgtgtcctgggtttcatccatccgacattgaagttgacttactgaagaatggrgagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattgggatgaattccaaattctgcttgcttgctttttaatat

SEQ ID NO: 38758 - DNA, 376 bp, Homo sapiens
gcatcaggagtatcaatcacctgagctcaccatagtcwaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcatttkktagaatgtgggtttgactattttctgtatgtctccatctattgatgagggtcttaga

SEQ ID NO: 38759 - DNA, 430 bp, Homo sapiens
  misc_feature 32: n = A,T,C or G
aacacaatccgttgcaaacccaaaggacccangtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttmaggtgccgggcgcaggaactgtgtgtgtcctacacaatggtgctattctgtgtcaaacacctctgtattttttaaaacatcaattgatattaaaaatgaaaagattattggaaagtacaaaaaag

SEQ ID NO: 38760 - DNA, 492 bp, Homo sapiens
catgttaatgagaatttccccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctactwgggargctgaggcamragtaatcrcttgarcccaggagrcrgaggttgcagtgagctgagatyrtgccaytgcactccarcctgggtgacagagtgagaccccgt

SEQ ID NO: 38761 - DNA, 338 bp, Homo sapiens
cccagcacttacattaatcagttatgtggctgggcacggtggttcacccctgtaaccccaacactttgggaggccaaggcggaggatcgcctgagcccagaaggtcggggatgcagcgaaccatgatcacaccactgcacttcagcctgagtgacakagtgagaccytgtctytacaaaaaatttacaaattagccagcatggtggcacgcccctgtagtccttgctcaggaggctgaggcaggaggatcacttgagcccaggagttggtggctgtagtgagctatgatcacaccaccacactccagcctgaatgacagattaagaccttgtcacttt

SEQ ID NO: 38762 - DNA, 751 bp, Homo sapiens
  misc_feature 56: n = A,T,C or G
acagacatttgtggaaaacagtttgtagagcttcctcaataaaaacacatatgatnccagcaatcccactactgggtattatatccaaaaggaaaatgaaatcagtatgttgaagaagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgrtgaaaccccrtctctacwamarawaatacaaaaattagctgggcgtggtgctgggcgcctgtaatcccagctgctcgcgaggctgaggcagggagaattgcttgaacccgggaggtggaggttgcagtgacccaagatcatgccactgcactccagcctgggcaacagagcgagactccatctcaaaataaataaataaacaaacaaacaaaggactgagataatcaatttgctattgaagaaagtgtggtaaaattgacactgcatatactagtatattagaatgtaaacaggtacaaattttagtaatgtgaatacgcagtcttaaagatgcccgtatctcttgcctcaataatctcacttaaaagtctatgccaaaaccgggcacagtgactcacgcctgtaatcctagcactttgggaggttgaggcaggaggctcgcttgagcccaac

SEQ ID NO: 38763 - DNA, 385 bp, Homo sapiens
  misc_feature 11, 14, 32, 47, 92: n = A,T,C or G
agtgtaacttnacnggcctaaaatgtttctanaaattagagtttgtnactttcttccctttgtacctaagagataaataggctcagttaganaaggactccctggccaggcgcagtgacttacgcctgtaatctcagcactttgggaggccaaggcgggcagatcacgaggtcaggagttcgagaccatcctggccaacatggtgaagccccgtctctgctagaaatataaaaattagctgggtgtggtggcaggagcctgtaatcccggctacacrgraggctgaggyasgagaatcgcttgaacycrggagrtggaggttkcagtgagccaakatcayrccacygyactccagcctgggcaacagagcragactccatctcga

SEQ ID NO: 38764 - DNA, 636 bp, Homo sapiens
cagtgtggcaacagtatcttatttgtaagacattcccagaaagtcagactcactcatattcaggtgtaagaaaatatattccaataccaaatatcaactttttgtgtaactttcacttgtctacccttccattattttgaatggtttagaatagaatgtatttcttttctattttagaactacttggaaattattaaactcatagttcaataaaatagtgttttgggctttttttctcttgactgtgtaaagtaaaatgaagaaaaagattgtccttagaagaatccctctctgttatttttgataattatatttctcccagggatagcatatttgaaaattcataactgttgggtcagcyryrgtggctcayrcctgtaatccyagcactttgggaggctgaggcaggtggatcatctgaggtcaggagtthgagaccagcctggccaacatggtgaaaccccgtctctactaaaaayataaaaattagccrggyrtggtggcrgrygcctgtaatcccagctaytygrgaggctgaggcasgagaatygcttgaayccagsaggcagaggktgcgrgtgagccragaytgcaccaytgcactccagccygggtgacagaktgagactcyrtctc

SEQ ID NO: 38765 - DNA, 667 bp, Homo sapiens
  misc_feature 32, 52, 86, 489: n = A,T,C or G
ataaactatgcatttaaagtactcagcttggncgggcatggtggctcatgcntgtaatcccagcattttgggaggccaaggtgggnggatctcctcaggtcaggagtttgagaccagcctgaccaatatagtgaaaccgcatctctactaaaaatacaaaattagctaggtgtggtggcgcatgccttgtaatcccagctactygggaggctgargcrggagratcgcttgrrccyrggaggcrgaggttgcagtgagcygagatkgcacyaytgcactccagcctgggtgtcggagcaggactctgtctcaaaaaggaaaagaaatgatgtaacatggcaccctggatgggattgtggatgagaaaatgcatattaggtagaaattaaggaaatctgaataatgtatggacttcaaattgtaagtatcagtatggttttattggttatgctacaataatgttgaaatggaggatattgggtacagggnttagaagaacttcctgtaatattcttacaatttttctgtaaacctgaaactaacctaaagtaaaaagtttattaaatcttaagaaaatcagagattgaacaattaaataccacattaaaaaaaagggaaaggaaatcttggtatctgataaggtaacattcataaccaaaaaagtatt

SEQ ID NO: 38766 - DNA, 703 bp, Homo sapiens
atataaagtctcaaaactggcagatgaataattagacagtaaaattattaagcaaaacaaggaaattattattataaaaagttagaatagtagttacctttgggggtggggggaaatgagggatattactggaataaagcacttgagaattttcatagaaaaaaagtaaggaaaagcactcccagggttaaatatacattgctcacatttatgtcttctacctctgtatctatatctgtaatatttcataatggtaattgatgactcagaggcatgaaaatatccagaattattttaagaattaattagtaactaataattatcatctataggctttagttacttgaacatagcaggaaagtagcagacaaattttggttaacatagttcaaaaagcatttttcttgcttaacccttagttaagaattaaaatataggccagatgcagtggytcaygcctrtaatcccaaaactttgggaggccgaggtgggcagatcacccgaggtcaggagttcgagaccggcctggccgacatggagaaaccccatttctactaaaaatacgaaaattagccgggtgtgatagcatgcgcctgtaatccctgaggcaggagaatcacttgaacctgggaggcggaggttgcagtgacctgacatcacgccactgcactccagcctgggcaacagggcaagactccatctc

SEQ ID NO: 38767 - DNA, 578 bp, Homo sapiens
ggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtg

SEQ ID NO: 38768 - DNA, 182 bp, Homo sapiens
cgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgawaaaararaaaaggagaag

SEQ ID NO: 38769 - DNA, 616 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcggtgagggtcaaaggagagtcaacatatgtgattgttccataataaacttctggtgtgaga

SEQ ID NO: 38770 - DNA, 165 bp, Homo sapiens
  misc_feature 164, 165: n = A,T,C or G
gtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccnn

SEQ ID NO: 38771 - DNA, 613 bp, Homo sapiens
  misc_feature 581, 587: n = A,T,C or G
cggggaggchttgaggcagccmgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattawtkgggagtnggtaanggatgaaacaatttgggagaagatag

SEQ ID NO: 38772 - DNA, 575 bp, Homo sapiens
  misc_feature 219, 230, 277, 575: n = A,T,C or G
gtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatanacttttttcanataacatcttctgagtcataaccagcctggcagtatgatggcctagnatgcagagaaaacagctccttggkgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcn

SEQ ID NO: 38773 - DNA, 491 bp, Homo sapiens
ataggcgatagcaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 38774 - DNA, 492 bp, Homo sapiens
ctcascatttggggacgctctcagctctckgcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgaattttttgggcctatttgaagayacctgctcagtatgacgcttctgagctaaaagcttccatgaaggggctgggaaccgacgaggactctctcattgagatcatctgctccagaaccaaccaggagctgcaggaaattaacag

SEQ ID NO: 38775 - DNA, 195 bp, Homo sapiens
  misc_feature 14, 32: n = A,T,C or G
agcctcacttttantgaaacaaatggcctttnttaaaaactgagtgactctatactagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 38776 - DNA, 862 bp, Homo sapiens
  misc_feature 183, 316, 336: n = A,T,C or G
gtttggagaaacctaaatggtggcttccatttaagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaangccctgctcatccagggctccaatgacgtggagatccgggcagagggcaatagcgggttcacgtacactgccctgaaggatggctgcacgaaacataccggtaagtggggcaagactgttatcgagtaccggncacagaagacctcacgcctncccatcrttgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttatttgtcttcctgtaagaccttcgggtcaaggcagaggcaggaaactaactggtgtgagtcaaatgccccctgagtgactgcccccagcccaggccagaagacctcccttcaggtgccgggcgcaggaactgtggtgtgtcctacacaatggtgctattctgtgtcaaacacctctgtattttttaaaacatcaattgatattaaaaatgaaaagattattggaaagt

SEQ ID NO: 38777 - DNA, 467 bp, Homo sapiens
gacccggcgctccattaaatagccgtagacggaacttcgcctttctctcggccttagcgccatttttttggaaacctctgcgccatgagtagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtgggccgagtgtaacaaccatataataaatcacctcttccgctgttttagctgaagaatt

SEQ ID NO: 38778 - DNA, 495 bp, Homo sapiens
  misc_feature 229, 269, 394: n = A,T,C or G
catgcaagttaccaaaactgtgataacccttttttacttactgtagagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagnaattgctaggattaaattaaggaaagtaaagctacycagnagcagcaggttccacaagcacaaactttacacatttgtacaattttgaaatgcactacaataaacaaattagagcaacacatttgaaatacaggcttctttacataaactgagaggttatacaanaactcagtttcacaagggaacaatctatacctttctaaaagttaatatttcaagtctctaataggcagaatattttactctttaaaatcctgcctttctga

SEQ ID NO: 38779 - DNA, 351 bp, Homo sapiens
  misc_feature 16, 65: n = A,T,C or G
gctttccggcggtgancgacctacgcacacgagtaacmtgccctctcgcaaaggatctccttcantccctctccagaagaggaagaagaggaaacacaagaagaaacgcctggtgcagaagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgkatt

SEQ ID NO: 38780 - DNA, 953 bp, Homo sapiens
  misc_feature 9: n = A,T,C or G
cagcttacnaacgacaaagcccgcgtcgaggtggagcgcgacaacctggccgaggacatcatgcgcctccgggagaaattgcaggaggagatgcttcaagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccacttgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgaagattcagaatatgaargrrggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgggggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattacc

SEQ ID NO: 38781 - DNA, 459 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagtaaccctctaaatccccttgtaaatttaactgttagtccaaagaggarcagctctttggacactaggaaaaaaccttgtagagagagtaaaaaatttaacacccatagtaggcctaaaagcagccaccaattaagaaagcgttcaagctcaacacccactaccs

SEQ ID NO: 38782 - DNA, 526 bp, Homo sapiens
caaactccccagtgagtgtgagcatttaagaascatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagttagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaaatctgtg

SEQ ID NO: 38783 - DNA, 558 bp, Homo sapiens
  misc_feature 14, 450: n = A,T,C or G
attgaatgtaaagnaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttcggagaaactcaaaccttcaagnccctaggtgtagccattttgtcaagtcatcaactgtatttttgtactggcattaacaaaaaaagagataaaatattgtaccattaaactttaataaaactttaaaagg

SEQ ID NO: 38784 - DNA, 624 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagagratccgagarcgctctaagcctgtccacgagctcaatagggaagcctgtgatgactacagactttgcgaaacgctacgccatggtttactggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcacctgcagtgagggtcaaaggagagtcaacatatgtggattgttccataataaacttctggtgtgatacttc

SEQ ID NO: 38785 - DNA, 619 bp, Homo sapiens
taggagcctctctccctactgctgctacacaagaccctgagactgacctgcaggacgaaaccatgaagagcctgatccttcttgtcatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcraacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 38786 - DNA, 347 bp, Homo sapiens
ccggcggtgacgacctacgcacacgagaacatgcctctcgcaaaggatctccttcatccctctccagaagaggagaagaggraacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggayaaaaaaga

SEQ ID NO: 38787 - DNA, 532 bp, Homo sapiens
  misc_feature 8, 10, 33, 47: n = A,T,C or G
ctcggccntntctggccgggccccctttcctcntttacctttcgtgnagtttcttttcccttaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaaagagtttcacaaatccttcaaaataaaaagtaatgacttagaaactg

SEQ ID NO: 38788 - DNA, 922 bp, Homo sapiens
  misc_feature 2, 3, 26, 104, 143, 146, 247, 361, 366, 398: n = A,T,C or G
tnntttaaaagaggtaagagcaacgngctttgggagcagagaagagggagaaagcagcatcttgcctggatgagccaggggacacagaagagaagcccactatntcatttaatctttacaactctcttgcaaggttccctggntgngaaaatacatgagataaatcatgaaggccacctatcatcctccttctgcttgcacaagtttcctgggctggaccgtttcaacagagaggcttatttgactntatgctagaagatgaggcttctgggataggcccagaagttcctgatgaccgcgacttcgagccctccctaggcccagtgtgccccttccgctgtcaatgccatcttcgagtggnccagngttctgatttgggtctggacaaagtgccaaangatcttccccctgacacaacctctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggat

SEQ ID NO: 38789 - DNA, 1024 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaarryrgaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatattaaagccaaaaattggataaaatagcactgaaaaaatgaggaaattatttggtaaccaatttattttaaaagcccatcaatttaatttctggtggtgcagaaatttagaaga

SEQ ID NO: 38790 - DNA, 794 bp, Homo sapiens
  misc_feature 20, 22, 53: n = A,T,C or G
tcccccgggactctcggccntntttggccgggcagacctttgtgttctcttcntttcagggtcttggctgcctgtgggcttccccaggtggcctggaggtgggcaacagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggacctgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttatggggatgggtcggatctcacaggctgagaactcgttcacctccaagcatttcatgaaaaagctgcttcttattaatcatacaaactctcaccatgatgtgaaagaagtttcacaaatccttcaaaataaaaagtaatgacg

SEQ ID NO: 38791 - DNA, 339 bp, Homo sapiens
  misc_feature 331, 333, 339: n = A,T,C or G
gacacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttgtananccctgn

SEQ ID NO: 38792 - DNA, 182 bp, Homo sapiens
attgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcgag

SEQ ID NO: 38793 - DNA, 199 bp, Homo sapiens
tggaaacctaagagttttattttctaaagcagaatacattccattaacttgacatcctttaaaaagttattaaggccgggcatggtggctcaygcctgtaatcccagcactttgggaggccgaggcrggcggmtcaygaggtcaggagatcgagacyatcctggctaacacggtaaaaccctgtctctactaaaagtgc

SEQ ID NO: 38794 - DNA, 492 bp, Homo sapiens
  misc_feature 24: n = A,T,C or G
agattgaggttcatcatcaatagnataaatgatagaacaattaaacaagaataaataaaggtgaatcattgttcaattatgaatatacatgatgatataagaaatattatcactaaaaattttaaacacagatgccccttaaagaaatggatcatgagtcccgccactgcactccagcctgggygacagagcgagactccrtttcaaataaataaataagtaaaaataaaaataaaaaaaagtaactcttacttgaatttattaagaatacacagatgatgttgccaaagtggcaatcaaattgctttgtcattttttactttttatgtatgtttgtatgtatgtatatatttgagagagagtcttgttctgtcactcaggctggagtgcagtggcgtgatgtcggctcattgcggtctctgcttcccgggttcaagtgatcttcctgcctcggcctcaggagtaactgggactacaggcatgcaccaaaca

SEQ ID NO: 38795 - DNA, 529 bp, Homo sapiens
gcaaaagataaggaaaatattaatgaaaaattgaaatggagactagccttgatccagaaggtccaccttctcaccttcaggacacatggcttaatgagcagatgatgctctttgactgggatccaggacttgatgggtgggacacaggctgaatttcagctttcactcttcagtgggatcttctagtgcatggtgcaacctgcataattatatatagcagccctgcaccttctacataataataggcctagaaagagattagaaacaaaatagaaacgaaaggaaaaaatagaggaaaatttatctgagctaaagaaaggctcagttgaagtcattagtttgaacagccttgctgattgtcaagagaagtaagtgcaaaagtatccataattagtctgcattcagatgcaggaacctggtgctagagaagctgcctcatgcacaggaactgggcattgaagctgtatatgctgctggagcctgatgctggagaaacctgtatggcaggaatgaagagctagagaagctg

SEQ ID NO: 38796 - DNA, 782 bp, Homo sapiens
tccccatctccgctcgcagamytacctggaagtttgggggtmttccytcccccaytgatactgtttttactaggtgcaactgtgaaggaaaaactttcttctttaaggattctcagtactggcgttttaccaatgmtataaaagatgcagggtaccccaaaccaattttcaaaggatttggaggacyaactggacaaatagtggcagcgctttcaacagctaaatataagaactggcctgaatctgtgtattttttcaagaagaggtggcagcattcagcagtatatttataaacaggaacctgtacagaagtgccctggaagaaggcctgctctaaattatccagtgtatggagaaacgacacaggttagggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagcagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 38797 - DNA, 567 bp, Homo sapiens
  misc_feature 20, 33, 34, 204: n = A,T,C or G
cccgggacctcggcccctcnggccggggactgnngacctgaaactgatgagatgagatgatgaaatgaaatggtgagatgaaatgatgagatgaaatgaaatagtgaaatgaaattgaaataaaatcgaaatgaagatgaamtgatgacgatgmygmaataaaatgatgaamtgagatgtgatgagatgaaatgatgacmtganaatgatgagatgagatgagatgacactgaaataatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgatgagatgaaatgaggtgaaatgaacttagatgaaatgtaatgagatgaaatgaaatgacmtaatgaaatgaaataatgaaatgagatgaaataaaataatgaaatgatgaaataatgaaatgaaaatgaaatggaaatgatgagatgagaagaaatgatgagatgaaatgatgaaatgatgagatgagac

SEQ ID NO: 38798 - DNA, 440 bp, Homo sapiens
  misc_feature 33, 58, 208: n = A,T,C or G
cagactctccacctttgggtcgctttgctgttngtgatatgagacagacagttgcggngggtgtcatcaaagcagtggacaagaaggctgctggagctggcaaggtcaccaagtctgcccagaaagctcagaaggctaaatgaatattatccctamtaccctgccacccccmctcttaactcagtggtggaagaaccggtctcagaancctgtttgtttcaattggccwtttaagtttagtagtaaaagactggttaatgataacaatgcatcgtaaaaccttcagaaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 38799 - DNA, 475 bp, Homo sapiens
gctctttccgcctctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacrttggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttywrgggatgtaatmmwtatatttacaaattaaaatgcctcatggactcksgtgctt

SEQ ID NO: 38800 - DNA, 643 bp, Homo sapiens
  misc_feature 8, 178, 179: n = A,T,C or G
atgctgantctcattcgatgctgtaacctccatgaaggtaagaaccatgtctgttttacttactgctgtgtccctagaccttagcaggtcttaactcatagtaatggtcaataagtatttgttgaatgattaaatgaatttttcttgtccactaaagactttcctgtatttcatactnnaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaaatctggcccgggtgtggtggctcacgcctgtartcccrgcacttygggaggccgaggtgagtggatcatgaagtcagatcgaaaccatcctggctaacacagtgaatccccatctcgactaaaaatacaaaaaattagccagatgtggtggtgggcgcctgtagtcccagctactcaggaggctgaggcaggagaatggcgtgaacccggggtcgggggagcttgcagtgagctgagattgtgccactgcactccagcctgggcgacagagcgagactctgtct

SEQ ID NO: 38801 - DNA, 646 bp, Homo sapiens
  misc_feature 22: n = A,T,C or G
agtctgtcgatcccaggccganacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccytccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatct

SEQ ID NO: 38802 - DNA, 524 bp, Homo sapiens
aagccaaagacaaaaaaaattttactacttttgagattgccccaatgtacagaattatataattctaacgcttaaatatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttatttacagccagaaagtgtgggctgaagatggttggtttcatgtttttgtattatgtatctttttgtatggkaaagactatattttgtacttaaccagatatatttttaccccagatggggatattctttgtaaaaaatgaaaataaagtttttttaat

SEQ ID NO: 38803 - DNA, 409 bp, Homo sapiens
  misc_feature 67: n = A,T,C or G
tgcagtggctcacacctgtaatcccagcactttgggaggttgaggcgggtggatcacttgaggtcangagttcaagaccagcctcgccaacatggtgaaaccccatttctatcgaaagtacaaaaaatgacaggcgcggtggctcatgcctgtaatcccagcactttgggaggccgaggcagacggatcacgaggtcagvagatcvagaccatcctggctaacatggtgaaaccccgtctctactaaaaatacaaaaaattagccgggcgtggtggcgggcacctgtagtcccagctactcgggaggctgaggcaggagaatggcgtgaacccaggaggcggagcttgcagtgagccgagatcgcgccattgcactccagcctgggcgacrgagbgagactcygtcaca

SEQ ID NO: 38804 - DNA, 449 bp, Homo sapiens
aacggaaaaggagaatcgcttgaacccgggagacggaagttgtggtgagctgagattgcaccattgcactccagcctgggcaacaagagtgaaactctattaaataaataaataaataaataaataaataaataaatagaataaaaaatacaaaatttggccrggcrcggtggctcaygcctktrrtyccagcactttgggaggccgaggtgggtggatcacytgaggtcaggagttcaagaccagcctggccaacrtggtgaarccccrtctstrctaarrwtascaaaaattagccgggcgtggtggcaggcgcctgtggtcacagctgctcgggaggctgaggcccgaggatcgcttgaaactgggaggtggaggttgcagtgagctgataactgcaccactgcactccagcctgggtgatagagtgagactcagtctcaaaaaac

SEQ ID NO: 38805 - DNA, 396 bp, Homo sapiens
  misc_feature 67, 109, 145, 168, 187, 193, 204, 224, 269, 277, 287, 314,348: n = A,T,C or G
ctacaaaaagaactagaagtatcacaactgtcacaaccttccggaaggagtagctgacctgacacanattgatgtcaatgtccaggatcatttctgggatgggaagggntgtgaggatgatctgttactgcaacttcagcgaatngctctgctgcccaaaagacgttntctttggaccaaagatctntttcgngattccttgcnacaatcaatgagaatcttcntgtattctggagaacaccattcctgatttcccacaaactgcactncatcagtntaactgcatnctctagtttctatataagtgcaatagnagcatagattctataaattcttacttgkctaagnacaagtaaatctgtgttaaacaagtagtaataaaagttaattcaatct

SEQ ID NO: 38806 - DNA, 578 bp, Homo sapiens
  misc_feature 14: n = A,T,C or G
agacaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctat

SEQ ID NO: 38807 - DNA, 470 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgmaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagyattactgaaatacataggcttatat

SEQ ID NO: 38808 - DNA, 590 bp, Homo sapiens
ggtttgcctgaggctgtaactgagagaaagattctggggctgtgttatgaaaatatagacattctcacataagcccagttcaccaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatmaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttag

SEQ ID NO: 38809 - DNA, 376 bp, Homo sapiens
  misc_feature 22: n = A,T,C or G
tgtcatcaaagcgtggacaagnaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaaggctggttaatgataacaatgcatcgtaaaaccttcagaaggaaaggagaatgttttgtggaccactttggttttcttttttgcgtgtggcagttttaagttattaagtttttaaaatcagtactttttaatggaaacaacttgaccaaaaatttgtcacagaattttgagacccattaaaaaagttaaatgaga

SEQ ID NO: 38810 - DNA, 402 bp, Homo sapiens
  misc_feature 399, 401: n = A,T,C or G
ataggaccatttttatttgcagcttgagtttttatatgaagttgcattattgtggacttggctgtcttgtgatgaatttttttcatatgtattctgtgccatactaytgttaaaatgaactgttgctattgtgagatggattttaactgacctattaagggtttctttcgaatggcactactttagggacattctagtatttgcttctattgtttgggccttgtggataatgtacagatttaaaaaacaaatcttgttgctgatttgtccatttctttccctgcactttgttacatctgggatacagtctaactcatctgatttaatatgcatttaaaaaaatgccataactaytaaacaccttgtttacagacagatgaaataaatttattccaaccnant

SEQ ID NO: 38811 - DNA, 492 bp, Homo sapiens
  misc_feature 140: n = A,T,C or G
agaggaccagtccaaacctgggcctgtctcctggatgcaccgcattcagtaagactctttaatttggcaaaggacacacacagcctcaggggtgacaggacctcagaacacactgtattcttcactgtgctttctcctcntgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacmctgtctctwctaaaaatacaaaaaattagccacgagtggtggctggcacctgtaattgtgccacgggaggctgaggcaggagaatcacttgaacctggggagatggaggttgctgtgagctgagattgtgccattgcacaccagcctgggcaacaagagcaaaaccctgtcgcg

SEQ ID NO: 38812 - DNA, 730 bp, Homo sapiens
  misc_feature 16, 275, 285: n = A,T,C or G
atggataggaagaatnaatatcatgaaaatggccctactgcccaaagtagtttatagattcaatactattcccatcaagctaccattgactttcttcacagaattagaaaaaactacttcaaatttcatatggaactaaaaaagagcccgtatagccaagacagtcctgagcaaaaagaacaaagctggaggcatcacactacctgacttcaaactatactacaaggctattactggtaccaaaacagatataaagaccaatggaacakaacagnaggcctcagnaaataatrccacacatmtacaaccatctgatytttgacaaacctgacaaaaacaagsaatggggaaaggrtwtyctatttaataaatgkrtgttrggaaaactggctagccatrtgyagaaaastgaaactggaccccttccttacaccttatayaaaaattaactsaagrtggattaaagayttaaayataagacctaaaaccataaaaaccctaggaaaaaatcttggcaatgccattcaagacataggcatgggcaaagatttcatggctaaaacaccaaaagcaatggcaacaaaggccaaaattgacaaatgggatctaattaaactaaagagcttctgcacagcaaaagaaactatcatcagagtgaaaagactacctacagaatgagaaaaattttgcaatctgtccatctgagaaaggtctaatatccagaatctac

SEQ ID NO: 38813 - DNA, 615 bp, Homo sapiens
  misc_feature 7: n = A,T,C or G
atctgtntcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccmaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgac

SEQ ID NO: 38814 - DNA, 164 bp, Homo sapiens; identical to SEQ ID NO: 34936

SEQ ID NO: 38815 - DNA, 517 bp, Homo sapiens
  misc_feature 9: n = A,T,C or G
gagcagagnaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataacccgaaatcaaagatggagacttttaagaacctgaagaaccttcacgcattgattcttgtcaacaataaaattagcaaagttagtcctggagcatttacacct

SEQ ID NO: 38816 - DNA, 148 bp, Homo sapiens
  misc_feature 2, 20, 26, 59: n = A,T,C or G
anagtgtggcccgagcaganggctantgtgctagaagggcaaagaagttggagttctantcttaggaaaatcaaggcccgcaaaggcaaataaatccttgttttgtcttcacccatgtaataaaaggtgtttattgttttgttcscac

SEQ ID NO: 38817 - DNA, 587 bp, Homo sapiens
attgcccacagtgccgacagttgtggatatttgaatcttcttgtcctctagactagggtcagcaaactttttctgtgaagaatcagatggtatatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccascctgrgcaacatagtragaccctgtctctacccagcaaaaactttagctgggtgcagtgatggcgcgcctgtagttgtggttactccagaggcagaggtgggaggatgactcgagcctgggaggttgaggctgcaagtgagctctcatcacaccactgcattccaacctggacaccagagtgagattctgtctcaaaaaaagcagaagtgaccatggagaaatcatattttttcctgtctcatcttgctgcagatgaaaccaaaaataaactagcctg

SEQ ID NO: 38818 - DNA, 624 bp, Homo sapiens
  misc_feature 235, 266: n = A,T,C or G
caaaggatttggaggactaactggacaaatagtggcagcgctttcaacagctaaatataagaactggcctgaatctgtgtattttttcaagagaggtggcagcattcagcagtatatttataaacaggaacctgtacggaagtgccctggaagaaggcctgctctaaattatccagtgtatggagaaacgacacaggttaggagaccgtcgcttttgaacgtgcctmtaggaccnttctcaaacacacaccmtcagaattcamtanttcacctgcccagactggcttmtcaagaccaaaggtgtcccttcmtaaatgaagttaaagtgagtattacctgtggagaggacttccaaatgtggttaccctcagctatatcactgcccaacatcagaaaacctgacggctatgattacctatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatatttgacatc

SEQ ID NO: 38819 - DNA, 686 bp, Homo sapiens
  misc_feature 403, 407: n = A,T,C or G
gagggctactgatagtaccaggccagctcctggatgtcaggcctacttttctccttagcagagagggtctccttgctatcctctgaccatgctacctcacgccaatccccaaagccaggaataggtgaggtaagtagggcaaaacacttgggaagaattcacacttgggcaccagccctgtgcaggcatggccctgagagggagtggctctgcaagttttgtgcataactcccttcgcttgcctcacctctgtcccactctacacaatcctttagtctggtctctgcccttccttcttcattctcccaccctaaatcctacccaacttcctcccaagatcagacacagctttcccttctcttactggaaatgctgctctcgtgatcaccataagaagagaggntcangccgggcatggtggctcaygcctgtaakcccagcmctttgggaagccttggcgggtggatcatgaggtcaggagattgaggccatcctggctaacacggtgaaaccccgtctctactaaaagtacaaaaaattagccggatgtggtggcttgtgcccatagtcccagctacttgggaggctaaggcaaaagaattgcttgaatctgggaggcggaggttgcagtgagctgagtttgcgccactgcactccaggttgggcaacagagtgagactcgtctc

SEQ ID NO: 38820 - DNA, 605 bp, Homo sapiens
  misc_feature 320: n = A,T,C or G
ctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagnagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagct

SEQ ID NO: 38821 - DNA, 622 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttca

SEQ ID NO: 38822 - DNA, 664 bp, Homo sapiens
  misc_feature 662: n = A,T,C or G
cgggcgtcgcggccgcccccgggggcttttcgatccgccatctgcggtgggtgtctgcacttcggctgctctcgggttagcaccctgtggtgccttctcttgtgatccctgacctaacctgtctcttgcttttcgatccgcctctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatganct

SEQ ID NO: 38823 - DNA, 473 bp, Homo sapiens
ggwaggagcctctctccctactgctgctacacaagaccctgagaactgacctgcaggacgaaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggrtacaatgctgcctataatcgctacttcaggaagcgccgagggaccaaatgagactgagggaagaaaaaaaatctctttttttctgggaggctggcacctgattttgtatccccctgtagcagcattactgaaatacataggcttat

SEQ ID NO: 38824 - DNA, 875 bp, Homo sapiens
  misc_feature 11: n = A,T,C or G
aagagcaaggnagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 38825 - DNA, 525 bp, Homo sapiens
ataataattaacattgatttaggtcttaacaaagtgctttcacttatagagtgatatttaatttggttctcaacaacgagatggatgacagctaacatgtactgagcatttacttgatggcagttcttatatgtcttatgagttttaccttacttaattctcccaacaatcctatgaggaaggtaatgttttgacccttgtttagaaaggataaaaaacaaggttaaagaagttaagtcataggccgggcacggtggctcacgcctgtaatcccagcattttgggaggccgagatgggtggatcacctgaggtcaggagttcgagaccagcctggccaacatggtgaaaccccatctctactaaaaaatacaaaaattagtcgggcatggtggcaggcacctgtaatcccagctactcaggaggctsaggcaggagaatyrcttgaacmtgggaggcrgaggttscagtgagcagagatcgtgccactgccctccagcctgagtgacagagtcagactctatccc

SEQ ID NO: 38826 - DNA, 663 bp, Homo sapiens
  misc_feature 4, 5, 7, 18, 22, 25, 26, 27, 31, 33, 34, 35, 36, 38, 39,45, 47, 49, 50, 62, 71, 78: n = A,T,C or G
atgnncnaactgcttgcngagnacnnntgcngnnnncnnctgcangncnnggcatggactanatgaaacanaaatcanaaagataataatttctgaatagctgcctcctgctctctttttgttgctgaaagaaagacagaagattagacaaaagtcttttctacatgacaaccagatgcatttctgcttttaaggaggcactgtcaatttcctaagtgaagaatggtttcagcacctttctttgtccatgagctctcttttcaccaatttcttaaattatattaagttgcaaaataaaacattccaaacatttcgaaaatgtgagggatcctaacccaccaccaccacacccagctaattttgtatttttagtagagacggggtttctccatgttggtcaggcagtctcaaactccccacctcaggtgatccacccgcctcggcctyccwragtgctrggattacaggcatgagccaccgcgcctggccactctttcttttaaaatttaaagataaaaatattttatttaaggccaggatcatatgccattttagaggggacaaaaactgaagatgctatagggagaaaatctgttgaaatactatttgaataagatgaatatatttaaagctagaaggccagttacttgcattttagggtag

SEQ ID NO: 38827 - DNA, 224 bp, Homo sapiens
  misc_feature 7, 224: n = A,T,C or G
aggctgntttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctatn

SEQ ID NO: 38828 - DNA, 460 bp, Homo sapiens
gaggcaytgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagrgaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatt

SEQ ID NO: 38829 - DNA, 496 bp, Homo sapiens
acatccaggttgtctacctymtaacaacaatatctctgtagttggatcaagtgacttctgcccacctggacacaacaccaaaaaggcttcttattcgggtgtgagtcttttcagcaacccggtccagtactgggrgatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattccttatttcactaaatgtaaaatttgggagtaaatattatatgtcaat

SEQ ID NO: 38830 - DNA, 808 bp, Homo sapiens
gctaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggg

SEQ ID NO: 38831 - DNA, 181 bp, Homo sapiens
gtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgamagaaaaaaagaaaag

SEQ ID NO: 38832 - DNA, 320 bp, Homo sapiens
cgaaaattracagmmattcatagtacatmwatcccctccttctaaatagtaaaaagctctgattgkacaagaaattacctgwgctagtcaagttgttgtytttccttgaacaactttggaaaaatggatttgacaagkacataatcagktctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgc

SEQ ID NO: 38833 - DNA, 494 bp, Homo sapiens
  misc_feature 379, 393: n = A,T,C or G
aatggaacagaacagagccctcagaaataacaccgcatagctacaactatctgatctttgacaaacctgacaaaaacaagaaatgtggaaaggattccctatttaataaatggtgctgggaaaactggctagccatgtgtagaaagctgaaactgaatcccttccttacaccttatacaaaaatcaattcaagatgtattaaagacttaaacgttagacctaaaaccataaaaaccctagaagaaaacctagacattaccattcaggacataggcatggggaaggacttcatgtctaaaacacgaaaagcaatggcaacaaaagacaaaattgacaaatgggatctaattaaactaaagagctcctgcacagcamaagnaaactaycatmagnagtgaacaggcaacctacaraatgggagaamattttyacaayctayycatctgacaaagggctaatatccagaatctacaaaaaaacttaaactaatttac

SEQ ID NO: 38834 - DNA, 439 bp, Homo sapiens
gggtgacagagttgaaactctgtctcaaaaaataaaataaaatacattttatatcattaactttactcttaggaatttttttcatatgtcatcgaaaaggttgcaagaaccaaaatcctagatacctatgtgacttgaaagtagagttttaggccaggygyggtcggctcaygcytgtaatcccagcactttgggaggccgagrcgggcrgatcacaaggtcaggaartycgagaccakcctgkcyaacacrgtgaaaccccgtctctactaaaaatacaaaaaattagctgggcdtggtggcgcacgcctgtaatcccagctactbgggaggctgaggcaggagaatcgcttgaacccgggargcaraggttgcagtgagccgagatcgcgccactgcactccagcctgggcgacagagcgagactctgtctcarmgg

SEQ ID NO: 38835 - DNA, 634 bp, Homo sapiens
  misc_feature 488, 491, 626, 634: n = A,T,C or G
tagccgatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtattttnctncatggaaattaagatagtgcatcttctgaggtcaattaaaaggagaaaaaatacaatttctcactttgcatttagtcaaaagaaaaaatgctttatagcaaaatgaaagagaacatgaaatgcttcttttctcanttttattn

SEQ ID NO: 38836 - DNA, 1020 bp, Homo sapiens
  misc_feature 1009: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttggaggtgattaaaataatttggaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaatccaaaaattggataaaatagcactgaaaaaatgaggaaattattggtaaccaatttattttaaaagcccatcaatttaatttctggtggtncagaagtccgg

SEQ ID NO: 38837 - DNA, 881 bp, Homo sapiens
tggaccgggggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttattttcaaaatgtttggaaacagtataatttgacaaagaaaaatgatacttctctttttttgctgttccaccmaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattact

SEQ ID NO: 38838 - DNA, 470 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatat

SEQ ID NO: 38839 - DNA, 791 bp, Homo sapiens
agttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggtta

SEQ ID NO: 38840 - DNA, 524 bp, Homo sapiens
gacaaccttagccaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 38841 - DNA, 161 bp, Homo sapiens
ctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 38842 - DNA, 810 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgrggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagatraaaacatacttttagaagaaaaaagataaatttaaaccwgaaaagtaggaagcagaagaaaaaagacaagctaggaaacaaaaagctaagggcaaaatgtacaaacttagaagaaaattggaaga

SEQ ID NO: 38843 - DNA, 777 bp, Homo sapiens
gaatgtgataagttctttaaaagaggtaagagcaacgtgctttgggagcagagaagagggagaaagcagcatcttgcctggatgagccaggggacacagaagagaagcccaccatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtggaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatgggggctttccagggaatg

SEQ ID NO: 38844 - DNA, 539 bp, Homo sapiens
ggagcatttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatccg

SEQ ID NO: 38845 - DNA, 831 bp, Homo sapiens
gctaacctagccccaaacccactccccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaaagtaaaaggaactcggcaaatcttaccccgcctgtttacc

SEQ ID NO: 38846 - DNA, 580 bp, Homo sapiens
cagggtcttggctgcctgtgggcttccccaggtggcctggaggtgggcaaagggaagtaacagacacacgatgttgtcaaggatggttttgggactagaggctcagtggtgggagagatccctgcagaacccaccaaccggaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctscttttcttcaccctscccttttttcttctattaatcaagag

SEQ ID NO: 38847 - DNA, 473 bp, Homo sapiens
  misc_feature 21: n = A,T,C or G
acagggaacaaaaataagatnacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaaagatgagttgtagacactgatctgctagtgctgtaatattgtaaatactggactcaggaacttttgttagg

SEQ ID NO: 38848 - DNA, 395 bp, Homo sapiens
ctggcgcaatagatatagtaccgcaagggaaagtatgaaaaattataaccaagcataatatagcaaggactaacccctataccttctgcataatgaattaactagaaataactttgcaaggagagccaaagctaagacccccgaaaccagacgagctacctaagaacagctaaargagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgyagagagagtaaaaaat

SEQ ID NO: 38849 - DNA, 320 bp, Homo sapiens
gacacgcttttcatctgtcccgctgcgtgttttcctcttgatcgggaactcctgcttctccttgcctcgaaatggaccccaactgctcctgctcgcctgttggctcctgtgcctgygccggctcctgcaaatgcaaagagtgcaaatgcacctcctgcaagaagagctgctgctcctgctgccctgtgggctgtgccaagtgtgcccagggctgcatctgcaaagggacgtcagacaagtgcagcttgctgtgcctgatgccaggacagctgtgctctcagatgtaaatagagcaacctatataaacctggatttttttt

SEQ ID NO: 38850 - DNA, 168 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccrggttcctcccggggctacgcctgtctgagcgtcgcttgccgaag

SEQ ID NO: 38851 - DNA, 275 bp, Homo sapiens
gattgaagcccccattcgtataataattacatcacaagacgtcttgcactcatgagctgtccccacattaggcttaaaaacagatgcaattcccggacgtctaaaccaaaccactttcaccgctacacgaccgggggtatactacrgtcaatgctctgaaatctgtggagcaaaccacagtttcatgcccatcgtcctagaattaattcccctaaaaatctttgaaatagggcccgtatttaccctatagcaccccctctaccccctctagagmc

SEQ ID NO: 38852 - DNA, 326 bp, Homo sapiens
gascacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatrgagcaacctatataaacctggatttttttttttttt

SEQ ID NO: 38853 - DNA, 482 bp, Homo sapiens
  misc_feature 6, 19: n = A,T,C or G
gttggnggatgaccttganccctsaggtawcgagtatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatgggggatgccttgcagaaagctgccaaggcagggcttttggcactttcagctttaacctttgctgggctttgctatttcaactatcacgatgtgggcat

SEQ ID NO: 38854 - DNA, 228 bp, Homo sapiens
  misc_feature 14, 16, 75, 93, 101: n = A,T,C or G
attgtcttcctgtnanaccttcgggtcaaggcagtatgcaggaaactaactggtgtgagtcaaatgccccctgantgactgcccccagcccangccagaanacctcccttcaggtgccgggcgcaggaactgtgtgtgtcctacacaatggtgctattctgtgtcaaacacctcctgtattttttaaaacatcaattgatattaaaaatgaaaagattattggaaagt

SEQ ID NO: 38855 - DNA, 586 bp, Homo sapiens
  misc_feature 9, 11: n = A,T,C or G
gacaacagnanacatcaaggaaattcttagaaattaaaaatatagtttttaagaccaaaacactcagaatgacagaatagtcatactggagaccacattcataatatgaagaaaaagtaaaaggaatcttcaagagagtagaatattaagacatgcagaaaatatgagaagaaaaatttgaagtcatagagaaagaaaaaaagaaaaaaaatagagaaaatgtacctttctaaaaagctttggtctttagatcaaaaaggcccacctaggctgggtgcagtggctcactcctataatctcgatactttggaaggccaaggtgggaggatcacttgagcacaggacttcaagactcagtatgtgcaacacactgagaacttatctctaccaaaaaaaagtaaataaataaataaaagtagcctggtatgggtggcwcwtgcctgtartcctagctacttgrgaggctgaagcaggagaatctcttgaaccttggaggcataggttgcagtgagccgagattgcaccattgcactccagcctcggggacaagagcaagactttgtttcaaaaaaaccaaaccaaaccg

SEQ ID NO: 38856 - DNA, 425 bp, Homo sapiens
  misc_feature 5, 10: n = A,T,C or G
ctgantgcantggagtgtgcattacctttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttgggggtttcctttaccttttctattaagttgtaccaaaacatccacttaagttctttgatttgtaccattccttcaaataaagaaatttggtaccca

SEQ ID NO: 38857 - DNA, 335 bp, Homo sapiens
  misc_feature 4, 37, 41, 42, 96, 129: n = A,T,C or G
attnggccgggatccccaccgcccttacgaacaagantaanncggatgggtggttcctgctgccctcaaggtcgtgcgtctgaagcctacaagaanagtttgcctatctggggcgcctggctcacgaangttggctggaagtaccaggcagtgacagccaccctggagggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcckc

SEQ ID NO: 38858 - DNA, 380 bp, Homo sapiens
gacaccccgggagctgagtgattgcagaaactggccttccatctctctcagcacaccaagctgcagatccaggcttttctgggaaagtgaggccaccatggctctggagaagtctcttgtccggctcctyctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaaga

SEQ ID NO: 38859 - DNA, 326 bp, Homo sapiens
grcmacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttt

SEQ ID NO: 38860 - DNA, 650 bp, Homo sapiens
  misc_feature 13, 32, 146: n = A,T,C or G
gtagggcctgagnattctgcatttctgacaantctcccaagcgatagcagtgcttctattcagtggaccacatgttggatagcagggttctgtaatatccatcataacattagaggtaaaggtttttaatcctagctgtttatcangaattgccttagagcctttaaaatatgtaggtgccaggccctgctttctacttactgaattggatccccagatgtagaaaacctcagcatctatatatttgaaaaccactacagggggctggatcacacgtgtaaacctagccctttgggaggccaaggcatgtggatcacttaaactaggagttcaagaccagcttgggcaacatrgtgaraccctgtytcctcaaaaaacacaaaaagtagccaggcgtggtggcgcccacctgtagtcccagctactcaggaggctgaagcagaggatcacctgaaccttgggggtcgaggctacagctagctgtgattgtaccactgcactcttgcctgagtgacagagtgagacaccaatctcaaaaacaacaaaaaatgcatattaaaaacatgtgagatgtttttacacatttcttatcacagagaaccccgtaaatatcgtatctgttatcttctggtaatttaatgttttctctc

SEQ ID NO: 38861 - DNA, 397 bp, Homo sapiens
gcataaagccaaatttccgtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatyc

SEQ ID NO: 38862 - DNA, 276 bp, Homo sapiens
  misc_feature 68: n = A,T,C or G
cgcagtggctcacgcctataatcccagcactttgagaggctgaggtgggcagatcacgaggtcaggangatcgagaccmtcctgastarcacggtgaaaccccgtctctactaaaaatacaaaaaattatgccaggygysgtggkgggygccwgtagtcccagctactygggaggctgaggcaggagratggygtgaaccygggaggyggagyttrcagtgagccragatygygccastrcacyccagcctgggcgayagagcgagactctgtctt

SEQ ID NO: 38863 - DNA, 474 bp, Homo sapiens
agcascmrggaggaggcagagcacagcatcktcgggaccagtactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccac

SEQ ID NO: 38864 - DNA, 501 bp, Homo sapiens
  misc_feature 18: n = A,T,C or G
cacccagggaacttcggntcttacggsmksssgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttat

SEQ ID NO: 38865 - DNA, 639 bp, Homo sapiens
gagatggagtcttactctgtcacccaggctggagtgcagtggcgtgatcttggctcactgcaacctccacctcccgggttcaagcaattctcctgcctcagcctcctgagcagctgggactacaggcgcctgccatcatgcctggctaatttttgtatttttagtagagacggggtttcaacatattggccaggctggtctcaaactcctaaccttgcgattcgcccgccttggcctcccaaagtgctgggawtmcaggcgtgagccactgcrcctggcctaaaatttgtatttttagttgacaataattgtatatctgagaattttaattgacacaactcagtgacctactataagtagttggtgaaagaaaaggacttacatatttctggatggagcaactatgtaaatgatggcagctctcatgagatagataatattggaatagaaaaacatttgagtaatataacgtgtcatttatttcaaatatattaagtttgaagtgtgtagtatgcaatttaatagtgaatctgaaactcaaaaattgtttacagttggtgttaaaaattcaaagttgtcagaatacggttgatggtggaaattgctggagtcagttggttcactgggggatataaagac

SEQ ID NO: 38866 - DNA, 339 bp, Homo sapiens
ccggcggtgacgacctacgcrcacgakaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttygrat

SEQ ID NO: 38867 - DNA, 466 bp, Homo sapiens
acacccggcgctccattaaatagccgtagtacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 38868 - DNA, 667 bp, Homo sapiens
agatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacargggctgcagaacaaatcaagcacatccttgctaatttcaaaaactaccagttctttattggtgaaaacatgaatcccagatggcattggttgctctattggactaccgtgaggattgggkgtgaccccatatatgattttctttaaggatggtttagaaatggaaaaatgttaacaaatgtggcaattattttggatctatcacctgtcatcataactggcttctgcttgtcatccacacaacacctggacttaagacaaatgggactgatgtcatcttgagctcttcatttattttgactgtgatttatttggagtggaggcattgtttttaagaaaaacatgtcatgtaggttgtctaaaaataaaatgcatttaaacgc

SEQ ID NO: 38869 - DNA, 572 bp, Homo sapiens
gcttttggctctctgaccgcaccatggcggttggcaagaacaagcgccttacgaaaggcggcaataaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttasaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaaga

SEQ ID NO: 38870 - DNA, 537 bp, Homo sapiens
gttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 38871 - DNA, 200 bp, Homo sapiens
  misc_feature 15: n = A,T,C or G
aagtaaaagactggntaatgataacaatgcatcgtaaaaccttcaggaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 38872 - DNA, 585 bp, Homo sapiens
gaggccttgaggcagccagcgcaggggcttytgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatg

SEQ ID NO: 38873 - DNA, 167 bp, Homo sapiens
  misc_feature 167: n = A,T,C or G
gtacgactcttagtcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcmran

SEQ ID NO: 38874 - DNA, 585 bp, Homo sapiens
  misc_feature 582: n = A,T,C or G
catacacaattactgtgtgctggacaagctgcgggactttgtggcctcgcccccgtgttggaaagtggcccaggtagattccttgaaggacaaagcacggaagctgtacaccatcatgaactcgttctgcaggagaagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtattgttttttattacctgggttaatgggaggnaat

SEQ ID NO: 38875 - DNA, 480 bp, Homo sapiens
tctttgtggctccggaaargcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttct

SEQ ID NO: 38876 - DNA, 670 bp, Homo sapiens
  misc_feature 180: n = A,T,C or G
cgggagatcgcggaacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggnaaacaagtttcacaaaagtaagcctacaagaagtacatcaaagattacatgaaatcaatcaaagggaaacttgaagaacagagaccagraagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 38877 - DNA, 591 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgatgcagggagaattgcgtcatttaaagcctagttaacgcatttactaaacgcagacgaaaatggaaagattattgggagtggtaggatgaaacaat

SEQ ID NO: 38878 - DNA, 353 bp, Homo sapiens
acacataaatatatgattgtgaaaaggtccacaaataaagccggaaatacagctctcaagattcatagtggacttcaggatcaagatagaagagggatctcatgctaaaaccttcccattctgctcttacacatagaaatgacatwkkaaatggtgtgtgtgtgtgtgtstgtgtgtgtgtgtgtgtgtgtgtggttatatctggtctctcagtgaggtgaccaatcccagctcccagctaattaggaaataacagacttctcagctcaaaaagaagagctgatctttaaaaagtcttaaaatatttgctaatagaacatggcaacacatattatttaagaattattgtttac

SEQ ID NO: 38879 - DNA, 495 bp, Homo sapiens
cattgagcaacgggccatgatgacaatggcggttttgtggaatagaaaggggggaaaggtggggaaargawwragaaatcggatkgttgcygtgtctstgtagaaagargtagacrtgggagactttycattttgttctgtactaagaaaaattcttmtgcctkgggwtgctgttaatctrtgrccttacccccaacccyktgctctctgaawcatgtgctgtgtccactcagggttaartggattaagggcggtgcaagatgtgctttgttaaacagatgcttgaaggcagcatgctccttragagtcatcaccactccctaatctcaartacccagggacacaaamactgcggaaggccgcagkgtcctctgcctaggaaaaccagagaccyttgttcacwtgtttatctgctgaccttccctccrctattgtcctatgaccstgccaaatccccctctscgagaaacacccaagaatratcaataaatacta

SEQ ID NO: 38880 - DNA, 481 bp, Homo sapiens
gagaagcaggaggttttcaacctagtcacagtagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggaga

SEQ ID NO: 38881 - DNA, 498 bp, Homo sapiens
  misc_feature 5, 6: n = A,T,C or G
cggcnnttttggccggrkmtcatmtatcctttacggcaagggtaccctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggaggggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtctt

SEQ ID NO: 38882 - DNA, 557 bp, Homo sapiens
  misc_feature 7: n = A,T,C or G
caatganaaccttgaaaactattacctggaggtcaatcaacttgagaagtttgacataaagagcttctgcaagatcctggggccattatcctactccaagawyaagcatttgcgtttggatggcaatcgcatctcagaaaccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacctccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttaggtggtttttttatttctactgtcaaatgatgtgcaaaaccttttactggttgcatggaaatcagccaagttttataatccttaaatcttaatgttcctcaaagcttggattaaatacatatg

SEQ ID NO: 38883 - DNA, 720 bp, Homo sapiens
  misc_feature 34, 288: n = A,T,C or G
agctgcaggaattgccagaaaaaatgcccatttnctcttcgggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagnagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttatccgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgct

SEQ ID NO: 38884 - DNA, 894 bp, Homo sapiens
  misc_feature 494, 525, 571, 665, 711: n = A,T,C or G
gagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtncccagtttctctgatagtgaccctgcagcanttattcatgactttgaaaagggaatgactgcttacctggacttgtntgctggggaactgctatctgatgcccctcaatacttctattgttatgcctccaaaaaatctggtagagctctttggcaaactggcgagtggcangatatctgcctcaaacttatgtggttcgagaagacctagttgctgnggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaaga

SEQ ID NO: 38885 - DNA, 484 bp, Homo sapiens
  misc_feature 28: n = A,T,C or G
gacccttttcacaagaatggcgccgaangcgaagcaaggaagctcctgcccctcctaaagctgaagccaaagcgaaggctttaaaggccaagaaggcagtgttgaaaggtgtccrcagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaaagaaggcatatgttcgactggctcctgattacgatgctttggatgttgccaacaaaattgggatca

SEQ ID NO: 38886 - DNA, 459 bp, Homo sapiens
sattcggcagggaagctgacatccacaccaagtcgagtacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagyctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactat

SEQ ID NO: 38887 - DNA, 476 bp, Homo sapiens
atcccatgcaacaacaagggagctcactcagtgggtttgatgtggtggatgctggctcgggaagttctgcgcatgcgtggcaccatttcccgtgaacacccatgggaggtcatgcctgatctgtayttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggkttgatgggaaaataaacattcagtttc

SEQ ID NO: 38888 - DNA, 159 bp, Homo sapiens; identical to SEQ ID NO: 33653

SEQ ID NO: 38889 - DNA, 628 bp, Homo sapiens
ggtaggagcctctctccctactgctgctacacaagaccctgagactgacctgcaggacgaaaccatgaagagcctgatccttcttgccatcctggccgccytagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtawkgaaagtgcactgcagtgagggtcaaagggagagtcaacatatgtggaattgttccataataaacttctgggkgtgatactttct

SEQ ID NO: 38890 - DNA, 323 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttt

SEQ ID NO: 38891 - DNA, 708 bp, Homo sapiens
  misc_feature 7, 651: n = A,T,C or G
acattancggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcangggctctagggactgccaggctgtttcagccaggaaggccaaaatcaagagtgagat

SEQ ID NO: 38892 - DNA, 471 bp, Homo sapiens
cagtgtggcaacagtatcttatttgtaagacattcccagaaagtcagactcactcatattcaggtgtaagaaaatatattccaataccaaatatcaactttttgtgtaactttcacttgtctacccttccattattttgaatggtttagaatagaatgtatttcttttctattttagaactacttggaaattattaaactcatagttcaataaaatagtgttttgggctttttttctcttgactgtgtaaagtaaaatgaagaaaaagattgtccttagaagaatccctctctgttatttttgataattatatttctcccagggatagcatatttgaaaattcataactgttgggtcagccacagtggctcacacctgtaatcccagcactttgggaggccgaggcgggcagaccatctgaggtcaggagttagagaccagcctggccaacatggtgaaaccctgtctcta

SEQ ID NO: 38893 - DNA, 336 bp, Homo sapiens
  misc_feature 3, 35, 36: n = A,T,C or G
aantctcttctttacagtacaatactacctaagannatgcaggaggagccaggcacgatggttcctgactgtaatcccagcaattcgggaggttgagagatgggagaatcgcttgagcctaggagtttgagactagcctgggcaatatagtgagaccttgtctctacaaaataaatttttaaaaattagctgagtgtggtggcatgcgcctgtaatcccagctacttgggaggctgaggtggcaggatcccttgagcctggggggtcaagcctgcagtaagccaagattgcaacactgtactccagcctgggtgacagagcaagaccgtgtctcag

SEQ ID NO: 38894 - DNA, 339 bp, Homo sapiens
gtcaaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcatttgttagaatgtgggtttgactattttctgtatgtctccatctattgatgagggtctt

SEQ ID NO: 38895 - DNA, 500 bp, Homo sapiens
  misc_feature 20, 22, 53: n = A,T,C or G
tcccccgggactctcggccntntttggccgggcagacctttgtgttctcttcntttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggacctgtcagttcttgggaaagtggtcagcgcatcctgcagggcttctcctcctctgtcttttggagaaccagggctcttctcaggggctctagggactgccaggctgtttcagccaggaaggccaaaatcaagagtgaga

SEQ ID NO: 38896 - DNA, 392 bp, Homo sapiens
  misc_feature 2: n = A,T,C or G
antccgagagcgctctaagcctgtccacgagctcaatagggaagcctgtgatgactacagactttgcgaaacgctacgccatggtttactggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcacctgcagtgagggtcaaaggagagtcaacatatgtggattgttccataataaacttctggtgtgatacttc

SEQ ID NO: 38897 - DNA, 193 bp, Homo sapiens
gaatcttagttcaactttaaatttgcccacagaaccctctaaatccccttgtaaatttaactgttagtccaaagaggaaacagctctttggacactaggaaaaaaccttgtagagagagtaaaaaatttaacacccatagtaggcctaaaagcagccaccaattaagaaagcgttcaagctcaacacccacta

SEQ ID NO: 38898 - DNA, 275 bp, Homo sapiens; identical to SEQ ID NO: 29736

SEQ ID NO: 38899 - DNA, 380 bp, Homo sapiens
  misc_feature 378: n = A,T,C or G
tttcggccggaaccgcctcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaagggaaaatgatcnga

SEQ ID NO: 38900 - DNA, 415 bp, Homo sapiens
  misc_feature 3, 8: n = A,T,C or G
aantggtnagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttatggggatgggtcggatctcacaggctgagaactcgttcacctccaagcatttcatgaaaaagctgcttcttattaatcatacaaactctcaccatgatgtgaaagaagtttcacaaatccttcaaaataaaaagtaatgacg

SEQ ID NO: 38901 - DNA, 299 bp, Homo sapiens
atctgtcccgctgcgtgttttcctcttgatcgggaactcctgcttctccttgcctcgaagtggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctgga

SEQ ID NO: 38902 - DNA, 176 bp, Homo sapiens
  misc_feature 10, 21, 22: n = A,T,C or G
aactgaggcnatgattaaganngacggccgggggcattcgtattgcgccgctagaggtgaaattcttggaccggcgcaagacggaccagagcgaaagcatttgccaagaatgttttcattaatcaggaacgaaagtcggaggttcgaagacgatcatgataccgtcgtagttccga

SEQ ID NO: 38903 - DNA, 192 bp, Homo sapiens
tagaatcttagttaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccact

SEQ ID NO: 38904 - DNA, 355 bp, Homo sapiens
agaacctccaatactgccatgagaaactagagggcaggtcttcataaaagccctttgaacccccttcctgccctgtgttaggagatagggatattggcccctcactgcagctgccagcacttggtcagtcactctcagccatagcactttgttcaccgtcctgtgtcagagcactgagctccacccttttctgagagttatttacagccagaaagtgtgggctgaagatggttggtttcatgtttttgtattatgtacctttttgtatggtaaagactatattttgtacttaaccagatatatttttaccccagatggggatattctttgtaaaaaatgaaaataaagttttttt

SEQ ID NO: 38905 - DNA, 250 bp, Homo sapiens
actgcagctgccagcacttggtcagtcactctcagcctagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagttttttt

SEQ ID NO: 38906 - DNA, 174 bp, Homo sapiens
ctctactaaaaatacagaaaaattagctgggcatggtggcacacgcctgtaatcccagctactggggaggctgaggcaggagaatcgcttgaacctgggaagcaaaggttgcagtgagccaagatcgcaccactgcacttcagcctgggcgacagagtgagactccgtctcaaa

SEQ ID NO: 38907 - DNA, 474 bp, Homo sapiens
tttgcctgaggctgtaactgagagaaagattctggggctgtgttatgaaaatatagacattctcacataagcccagttcaccaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgag

SEQ ID NO: 38908 - DNA, 165 bp, Homo sapiens
cgactcttagtcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatc

SEQ ID NO: 38909 - DNA, 433 bp, Homo sapiens
gggtgacagagttgaaactctgtctcaaaaaataaaataaaatacattttatatcattaactttactcttaggaatttttttcatatgtcatcgaaaaggttgcaagaaccaaaatcctagatacctatgtgacttgaaagtagagttttaggccaggtgcggtggctcatgcttgtaatcccagcactttgggaggccgaggcgggcagatcacaaggtcaggagttcgagaccagcctgtccaacacagtgaaaccccgtctctactaaaaatacaaaaattagctgggcgtggtggcgcatgcctgtaatcccagctacttaggaggccgaggcaagagaatcacttgaacccgggaggcagagtttgcagtgagccgagatccgccactgtactccagcctgggcgacagagctagactctgtctcagc

SEQ ID NO: 38910 - DNA, 467 bp, Homo sapiens
  misc_feature 13: n = A,T,C or G
gacaaccttagcnaacctttacccaaataaagtataggcgatagaaattgaaacctggcgcaatagatatagtaccgcaagggaaagatgaaaaattataaccaagcataatacagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcct

SEQ ID NO: 38911 - DNA, 440 bp, Homo sapiens
  misc_feature 13: n = A,T,C or G
gacaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 38912 - DNA, 434 bp, Homo sapiens
gtgcaagtgcatgatcgaccggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaaagattgactttgacagtgtgtccagcatcatggcctcctcccagtaacttcaggtgtttaataaagatgtgttga

SEQ ID NO: 38913 - DNA, 220 bp, Homo sapiens; identical to SEQ ID NO: 25899

SEQ ID NO: 38914 - DNA, 256 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctat

SEQ ID NO: 38915 - DNA, 140 bp, Homo sapiens
  misc_feature 2, 19, 68: n = A,T,C or G
anagtgtggccgagcaganggctatgtgctagaagggcaaagagttggagttctatcttaggaaaatnaaggcccgcaaaggcaaataaatccttgttttgtcttcacccatgtaataaaggtgtttattgttttgttcg

SEQ ID NO: 38916 - DNA, 163 bp, Homo sapiens
ctagtagaacagcaagaagcaattactactcgttctgggcagaccttatccaaagtctggtacaactgtccttagactgatgagcaaaggaggagtcaactaatgaagaaatgaataataaattttgacactgaaaaacattttattaataaagaatattgac

SEQ ID NO: 38917 - DNA, 144 bp, Homo sapiens
  misc_feature 30, 32, 35, 38, 43, 45, 48, 52, 53, 77, 83, 96, 113, 124: n = A,T,C or G
ttgacagacattcatagtacatatatcccntnctnctnaatantnaanagcnntgattggacaagaaattacctganctagtnaagttgttgtctntccttgaacaactttgnaaaaatggatntgacaaggacataatcaggt

SEQ ID NO: 38918 - DNA, 476 bp, Homo sapiens
caaaggatttggaggactaactggacaaatagtggcagcgctttcaacagctaaatataagaactggcctgaatctgtgtattttttcaagagaggtggcagcattcagcagtatatttataaacaggaacctgtacggaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgtt

SEQ ID NO: 38919 - DNA, 186 bp, Homo sapiens
  misc_feature 2: n = A,T,C or G
tnaatgataacaatgcatcgtaaaaccttcgaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 38920 - DNA, 376 bp, Homo sapiens; identical to SEQ ID NO: 38809
  misc_feature 22: n = A,T,C or G

SEQ ID NO: 38921 - DNA, 258 bp, Homo sapiens
acatccaggttgtctaccttctaacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgct

SEQ ID NO: 38922 - DNA, 443 bp, Homo sapiens
  misc_feature 14: n = A,T,C or G
agacaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacactaggaaaaaaccttgtagagagagc

SEQ ID NO: 38923 - DNA, 469 bp, Homo sapiens
  misc_feature 8, 13: n = A,T,C or G
gagcaganaaganggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataacccgaaatcaaagatggagacttttaagaacctgaagaaccttcacgcattgattc

SEQ ID NO: 38924 - DNA, 425 bp, Homo sapiens
  misc_feature 36, 67: n = A,T,C or G
aggagaccgtcgcttttgaacgtgcctctaggaccnttctcaaacacacaccctcagaattcactanttcacctgcccagactggcttctcaagaccaaaggtgtcccttcctaaatgaagttaaagtgagtattacctgtggagaggacttccaaatgtggttaccctcagctatatcactgcccaacatcagaaaacctgacggctatgattacctatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaaggaatatttgacatc

SEQ ID NO: 38925 - DNA, 316 bp, Homo sapiens
  misc_feature 6, 8, 29: n = A,T,C or G
cgaaantnaacagcaattcaagtaatcantcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgc

SEQ ID NO: 38926 - DNA, 147 bp, Homo sapiens
  misc_feature 2, 20, 26, 58, 64: n = A,T,C or G
anagtgtggcccgagcaganggctantgtgctagagggcaaagaagttggagttctantcttangaaaatcaaggcccgcaaaggcaaataaatccttgttttgtcttcacccatgtaataaaaggtgtttattgttttgttcccac

SEQ ID NO: 38927 - DNA, 469 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgaaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttata

SEQ ID NO: 38928 - DNA, 470 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagtattactgaaatacataggcttatat

SEQ ID NO: 38929 - DNA, 420 bp, Homo sapiens
  misc_feature 13, 47: n = A,T,C or G
gacaaccttagcnaaccctttacccaaataaagtataggcgataganattgaaacctggcgcaatagatatagtaccgcaagggaaagatgaaaaattattaaccaagcataatatagcaaggactaacccctattaccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 38930 - DNA, 245 bp, Homo sapiens
caattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgac

SEQ ID NO: 38931 - DNA, 284 bp, Homo sapiens
  misc_feature 4: n = A,T,C or G
gacnaccctgggcaacatagtgagaccctgtctctacccagcaaaaactttagctgggtgcagtgatggcgcgcctgtagttgtggttactccagaggcagaggtgggaggatgactcgagcctgggaggttgaggctgcaagtgagctctcatcacaccactgcattccaacctggacaccagagtgagattctgtctcaaaaaaagcagaagtgaccatggagaaatcatattttttcctgtctcatcttgctgcagatgaaaccaaaaataaactagcctg

SEQ ID NO: 38932 - DNA, 158 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggctcctcccggggctacgcctgtctgagcgtcgcttgc

SEQ ID NO: 38933 - DNA, 400 bp, Homo sapiens
gagggctactgatagtaccaggccagctcctggatgtcaggcctacttttctccttagcagagagggtctccttgctatcctctgaccatgctacctcacgccaatccccaaagccaggaataggtgaggtaagtagggcaaaacacttgggaagaattcacacttgggcaccagccctgtgcaggcatggccctgagagggagtggctctgcaagttttgtgcataactcccttcgcttgcctcacctctgtcccactctacacaatcctttagtctggtctctgcccttccttcttcattctcccaccctaaatcctacccaacttcctcccaagatcagacacagctttcccttctcttactggaaatgctgctctcgtgatcaccataagaagaga

SEQ ID NO: 38934 - DNA, 469 bp, Homo sapiens
aatggaacagaacagagccctcagaaataacaccgcatagctacaactatctgatctttgacaaacctgacaaaaacaagaaatgtggaaaggattccctatttaataaatggtgctgggaaaactggctagccatgtgtagaaagctgaaactgaatcccttccttacaccttatacaaaaatcaattcaagatgtattaaagacttaaacgttagacctaaaaccataaaaaccctagaagaaaacctagacattaccattcaggacataggcatggggaaggacttcatgtctaaaacacgaaaagcaatggcaacaaaagacaaaattgacaaatgggatctaattaaactaaagagctcctgcacagcaaaagaaactaccatcagagtgaacaggcaacctacaaaatgggagaaaattttcacaacctactcatctgacaaagggctaatatccagaatcta

SEQ ID NO: 38935 - DNA, 359 bp, Homo sapiens
  misc_feature 5: n = A,T,C or G
cgcantagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagaagaatcttagttcaactttaaatttgcccacagaaccctctaaatccccttgtaaatttaactgttagtccaaagaggaacagctctttggacacta

SEQ ID NO: 38936 - DNA, 477 bp, Homo sapiens
cataacaacaatatctctgtagttggatcaagtgacttctgcccacctggacacaacaccaaaaaggcttcttattcgggtgtgagtcttttcagcaacccggtccagtactgggggatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattccttatttcactaaatgtaaaatttgggagtaaatattatatgtcaat

SEQ ID NO: 38937 - DNA, 389 bp, Homo sapiens
aaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgtcctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagc

SEQ ID NO: 38938 - DNA, 464 bp, Homo sapiens
  misc_feature 7: n = A,T,C or G
atctgtntcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcac

SEQ ID NO: 38939 - DNA, 406 bp, Homo sapiens
  misc_feature 8, 405: n = A,T,C or G
agcagagnaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgtcaaaggatcttccccctgacacaactctgctagacctgcaaaacanc

SEQ ID NO: 38940 - DNA, 329 bp, Homo sapiens
attgcccacagtgccgacagttgtggatatttgaatcttcttgtcctctagactagggtcagcaaactttttctgtgaagaatcagatggtatatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagac

SEQ ID NO: 38941 - DNA, 203 bp, Homo sapiens
gttcctccttttcttaccctccccttttttcttctattaataaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttag

SEQ ID NO: 38942 - DNA, 270 bp, Homo sapiens
catggtggctcatgcctgtaagcccagcactttgggaagccttggcgggtggatcatgaggtcaggagattgaggccatcctggctaacacggtgaaaccccgtctctactaaaagtacaaaaaattagccggatgtggtggcttgtgcccatagtcccagctacttgggaggctaaggcaaaagaattgcttgaatctgggaggcggaggttgcagtgagctgagtttgcgccactgcactccaggttgggcaacagagtgagactcgt

SEQ ID NO: 38943 - DNA, 159 bp, Homo sapiens
  misc_feature 139, 158, 159: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttnn

SEQ ID NO: 38944 - DNA, 217 bp, Homo sapiens
  misc_feature 217: n = A,T,C or G
tttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctatn

SEQ ID NO: 38945 - DNA, 463 bp, Homo sapiens
  misc_feature 6, 31: n = A,T,C or G
gaggcnctgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagggaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaa

SEQ ID NO: 38946 - DNA, 273 bp, Homo sapiens
cgtggtcggctcacgcctgtaatcccagcactttgggaggccgagacgggcggatcacaaggtcaggaaatccgagaccatcctggctaacacggtgaaaccccgtctctactaaaaacacaaaaaattagctgggcttggtggcgggcacctatagtcccagttactcgggaggctgagccaggagaatggcgtgaacccgggagacggagcagtgagccgagatcgcgccactgcactccagtgtgggcgacacagcgagactctgtctca

SEQ ID NO: 38947 - DNA, 126 bp, Homo sapiens
  misc_feature 11, 25: n = A,T,C or G
acagcacaagnaaactatcataagnagtgaacaggcaacctacagaatgggagaacatttttacaatctatccatctgacaaagggctaatatccagaatctacaaaaaaacttaaactaatttac

SEQ ID NO: 38948 - DNA, 471 bp, Homo sapiens
tttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcccgctccacccagagaagcacactttgtgagaaccaatg

SEQ ID NO: 38949 - DNA, 161 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctt

SEQ ID NO: 38950 - DNA, 199 bp, Homo sapiens
agcttaatagtagtagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctaca

SEQ ID NO: 38951 - DNA, 472 bp, Homo sapiens
cagaggaacaagcatgtctctctgccagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgc

SEQ ID NO: 38952 - DNA, 302 bp, Homo sapiens
atggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtg

SEQ ID NO: 38953 - DNA, 222 bp, Homo sapiens
gataaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 38954 - DNA, 426 bp, Homo sapiens
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaataaaaaaatgaaacttttttgagtaataaaaatgaaaaga

SEQ ID NO: 38955 - DNA, 473 bp, Homo sapiens
  misc_feature 466: n = A,T,C or G
acagcttctccagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaagtgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggggggngattatt

SEQ ID NO: 38956 - DNA, 278 bp, Homo sapiens
  misc_feature 258: n = A,T,C or G
cgcagtggttcacgcctgtaatcccagcactttgggaggctgaggcgggcggatcacgaggtcaggagtttgagaccagcctcaccaatgtggtgaaaccctgtctctagtaaaaatacaaaaattagctgggcatggtggtgcatgcctgtaatcccagctactcggaaggctgaggcaggagaatcacttgaatccgggaggcagaggttgcagtgagccgagattgtgccacagcactccagcctgggcaatagnagtgggactccatctcaaag

SEQ ID NO: 38957 - DNA, 216 bp, Homo sapiens
agaacagaaaaaataagatgcattctaatggatctttgacactttttggtaatgaagcttttagttcccatagagttgtgtgtaggtcagaaaatctgccaagtttcttactctatgttcagctcaagtttgctctggcaccaaagaggagagaaacggggggttgcagaaaacagggggttgagagctttatctttttgtcctttactttcatct

SEQ ID NO: 38958 - DNA, 470 bp, Homo sapiens
agactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaatgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgca

SEQ ID NO: 38959 - DNA, 331 bp, Homo sapiens
aagtgctgggattacaggcgtgagccccgcgcccggccctcaatttgcaatttatttagaacttttgtatctgttttcaaagtgagtttggctcactgcttcctatttttgcgtgagtgtgcccgctctccatttctggtttctgtaccagggctatgttagttttctggaatgagtttctttatctttttctactctctggaacagcttatattaacataagaattatccattccttgaaagcctactagaatctgcctatatagctatctgggtcggtgattttttttaagatataggtctttgtctacttttacatttttttctaaga

SEQ ID NO: 38960 - DNA, 473 bp, Homo sapiens
atgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtat

SEQ ID NO: 38961 - DNA, 401 bp, Homo sapiens
  misc_feature 320: n = A,T,C or G
atagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtngagagagtaaaaaatttaacacccatagtaggcctaaaagcagccaccaattaagaaagcgttcaagctcaacacccacta

SEQ ID NO: 38962 - DNA, 472 bp, Homo sapiens; identical to SEQ ID NO: 26019

SEQ ID NO: 38963 - DNA, 240 bp, Homo sapiens
  misc_feature 13: n = A,T,C or G
caccctctaaatnccacgattaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctc

SEQ ID NO: 38964 - DNA, 244 bp, Homo sapiens
agagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttg

SEQ ID NO: 38965 - DNA, 470 bp, Homo sapiens
  misc_feature 422: n = A,T,C or G
gaggcattgaggcagccagcgcaggggcttctgctgagggggcaggcggagcttgaggaaaccgcagataagtttttttctccttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgggaggngattaaaataattttggaaggcgatcttttaaaaaagagattaaaccg

SEQ ID NO: 38966 - DNA, 473 bp, Homo sapiens
  misc_feature 453: n = A,T,C or G
aatttttttttatttttatttttttgagagacaaggtttcaccatgttgcccaggctggtgttgaactcctgggctcaagcaattctcctgcctcaggctcccgagtggctgggattacgggcgtgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctangaagccctggacaaaggata

SEQ ID NO: 38967 - DNA, 471 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatata

SEQ ID NO: 38968 - DNA, 311 bp, Homo sapiens
  misc_feature 2, 4, 27: n = A,T,C or G
angnataagctccgtggccttagctgngctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgccctgccgtgtgaac

SEQ ID NO: 38969 - DNA, 273 bp, Homo sapiens
cgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggctgaggcaggagaatggcgtgaactcagaaggtggagcttgcagtgagctgagaccgtgccactgcactccagcctgggcgacagagcgagactccgc

SEQ ID NO: 38970 - DNA, 456 bp, Homo sapiens
  misc_feature 9, 86: n = A,T,C or G
cgcaatagnatatagtaccgcaagggaaagatgaaaaattataaccaagcataatatagcaaggactaacccctataccttctgcntaatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 38971 - DNA, 472 bp, Homo sapiens
aaataaaataataaaaatttatttttttattaacgaataatagagttgatttaataaatcaactctattattctaggcagatttcatagcctaactccccttcaccaaattcagtgctgtatttcatagtgattgactcagaggagaaagatctgtgacttctatcttgctgcatgaccttggggaaaattggcttaaatgtatgaaaggatatttcaggcattgactcagactaaataaatgtgctaaatttgatacagtgagtgggaaatttttctcaccacatggaaccactaatgagcttgggaagtaaacatagttaagtaggcatagttgccttttttgttacaatcattctgaattggtccattagcctgaataacatttcaatgaacttcacatttgtagctttaggattgaccaaaccaaaccgcaacattataaactatttccaggtgagagggttgtagtg

SEQ ID NO: 38972 - DNA, 465 bp, Homo sapiens
tttcggccggaaccgccatcttccagtaattcgccaaaatgacgaacacaaagggaaagaggggaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaa

SEQ ID NO: 38973 - DNA, 171 bp, Homo sapiens
atggtgaaaccctgtctctactaaaaatacaagaattagtcaggcgtggtggcatgtgcctgtaatcccagctactcgggaggctgaggcaggagaatcgcttgaacctgggaggtggaggttgcagtgagccgagatcacgccgctgcactctagcctgggtgatagaac

SEQ ID NO: 38974 - DNA, 160 bp, Homo sapiens
actacagagtgtgcacactggctatcattgatccggtgactctgacatcattagaagcatgccagaacagactggtgaaaagtaaaccttttcacctacaaaatttcacctgcaaaccttaaacctgcaaaattttcctttaataaaatttgcttgtttt

SEQ ID NO: 38975 - DNA, 467 bp, Homo sapiens
ggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaat

SEQ ID NO: 38976 - DNA, 427 bp, Homo sapiens
  misc_feature 27, 29, 54, 351: n = A,T,C or G
cctcgagtgggcaaagggaagtaacantnacacgatgttgtcaaggatggtttngggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcangggctctagggactgccaggctgtttcagccaggaaggccaaaatcaagagtgagatgtagaaagttgtaaaatag

SEQ ID NO: 38977 - DNA, 437 bp, Homo sapiens
acggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttaga

SEQ ID NO: 38978 - DNA, 391 bp, Homo sapiens
  misc_feature 162, 284, 292, 346, 358, 365, 385, 391: n = A,T,C or G
cactagcagatagagttatcctttcttctggctcttgtttccctcccaagacagctacatctcaccatttgccttggcctcctttatttctccttctattcatcttttgtacttggagtggtccgcaaggtgaggagagttgagctcaatgaaaagaagganggtttttgccttttttatgcagaacaatgtcttcaaaaaaatcagaacagaaaaaataagatgcattctaatggatctttgacactttttggtaatgaagcttttagttcccatagagttgngtgtaggncaaaaaaatctgccaagtttcttactctatgttcagctcaagtttgctctggcnccaaaaaagganaaaaacngggggggtgcaaaaaaacangggggn

SEQ ID NO: 38979 - DNA, 465 bp, Homo sapiens
attccactgagccccctacagccgaagatatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaat

SEQ ID NO: 38980 - DNA, 330 bp, Homo sapiens
  misc_feature 14: n = A,T,C or G
gaggaaaccgcagnataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtg

SEQ ID NO: 38981 - DNA, 336 bp, Homo sapiens
atccccgttccgtgagttaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacat

SEQ ID NO: 38982 - DNA, 432 bp, Homo sapiens
gacagccttccctaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctgga

SEQ ID NO: 38983 - DNA, 335 bp, Homo sapiens
tgctaaaaatgaaaattctaacccaagtacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaa

SEQ ID NO: 38984 - DNA, 407 bp, Homo sapiens
  misc_feature 406: n = A,T,C or G
ccaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaang

SEQ ID NO: 38985 - DNA, 394 bp, Homo sapiens
catgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattctcgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggagga

SEQ ID NO: 38986 - DNA, 160 bp, Homo sapiens; identical to SEQ ID NO: 33749

SEQ ID NO: 38987 - DNA, 416 bp, Homo sapiens
  misc_feature 4, 42: n = A,T,C or G
tagncccctctctccctactgctgctacacaagaccctgagnactgacctgcaggacgaaaccatgaagagcctgatccttcttgccatcctggccgccttagcggtagtaactttgtgttatgaatcacatgaaagcatggagtcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctg

SEQ ID NO: 38988 - DNA, 160 bp, Homo sapiens
  misc_feature 19: n = A,T,C or G
cgactcttagcggtggatnctcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 38989 - DNA, 279 bp, Homo sapiens
  misc_feature 6, 258, 277: n = A,T,C or G
actctnccggggacgttgtctgcaggcactcataatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcancagggcctatggtggtttnat

SEQ ID NO: 38990 - DNA, 111 bp, Homo sapiens
cgcggtggctatgcctgtaatcccagcactttgtgaggccgaggcaggcgaatcacgaggtcaggagatcgagaccatcctggctaacacggtgaaaccccgtctctacca

SEQ ID NO: 38991 - DNA, 382 bp, Homo sapiens
  misc_feature 355: n = A,T,C or G
cggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcangaactgtgtgtgtcctacacaatggtg

SEQ ID NO: 38992 - DNA, 117 bp, Homo sapiens
acttattcactatcatgataatagcacgggaaagaccagccctcatgattcaattacctccccctgggtccctcccacaacatgtgggaattcaggaagatacaattcaagttgaga

SEQ ID NO: 38993 - DNA, 419 bp, Homo sapiens
  misc_feature 55: n = A,T,C or G
gatgcattctgagaaaagtgtccttaggcaattttttcttgtgcaaacatcattntatgtacaaatctagatggtagagcctactatacacctagtgtaccagtctgttttcatgcagctgataaagacatacccgacactgggaagaaaagaggtttaattgaacttacacttccacatggctgggaaggcttcagaatcatggcgggaggcgaaaggcccttcttacatggaggaggcaagagaaaatgaggaagaagcaaaggcaagaacccctgataaacccatcagatctcatgagacttattcactatcatgagaatagcacgggaaagaccagccctcatgattcaattacctccccctgggtccctcccacaacatgtgggaattcaggaagatacaattcaagttgagat

SEQ ID NO: 38994 - DNA, 460 bp, Homo sapiens
  misc_feature 405: n = A,T,C or G
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtangcctaaaagcagccaccaattaagaaagcgttcaagctcaacacccactacctga

SEQ ID NO: 38995 - DNA, 256 bp, Homo sapiens
cagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattatt

SEQ ID NO: 38996 - DNA, 170 bp, Homo sapiens
agcaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 38997 - DNA, 481 bp, Homo sapiens
agttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctt

SEQ ID NO: 38998 - DNA, 159 bp, Homo sapiens
gactcttagtcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 38999 - DNA, 150 bp, Homo sapiens
  misc_feature 33: n = A,T,C or G
gactcttagcggtggatcactcggctcgtgcgncgatgaagaacgcagctagctgcgagaattaatgtgaattgcaggacacattgatcatcgacacttcgaacgcacttgcggccccgggttcctcccggggctacgcctgtctgagcg

SEQ ID NO: 39000 - DNA, 482 bp, Homo sapiens
gagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcatt

SEQ ID NO: 39001 - DNA, 468 bp, Homo sapiens
  misc_feature 20, 25: n = A,T,C or G
acagggaacaaaataagatncaatnccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaaagatgagttgtagacactgatctgctagtgctgtaatattgtaaatactggactcaggaacttttgtta

SEQ ID NO: 39002 - DNA, 469 bp, Homo sapiens
  misc_feature 11: n = A,T,C or G
ccaatacattnaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattact

SEQ ID NO: 39003 - DNA, 467 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctatccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 39004 - DNA, 473 bp, Homo sapiens
  misc_feature 470: n = A,T,C or G
atcatgaactcgttctgcaggagaagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtattgttttttattacctgggttaatgggaggnaat

SEQ ID NO: 39005 - DNA, 473 bp, Homo sapiens
ataataattaacattgatttaggtcttaacaaagtgctttcacttatagagtgatatttaatttggttctcaacaacgagatggatgacagctaacatgtactgagcatttacttgatggcagttcttatatgtcttatgagttttaccttacttaattctcccaacaatcctatgaggaaggtaatgttttgacccttgtttagaaaggataaaaaacaaggttaaagaagttaagtcataggccgggcacggtggctcacgcctgtaatcccagcattttgggaggccgagatgggtggatcacctgaggtcaggagttcgagaccagcctggccaacatggtgaaaccccatctctactaaaaaatacaaaaattagtcgggcatggtggcaggcacctgtaatcccagctactcaggaggctcaggcaggagaattgcttgaacctgggaggcagaggttccagtgagc

SEQ ID NO: 39006 - DNA, 470 bp, Homo sapiens
  misc_feature 320: n = A,T,C or G
ctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagnagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctca

SEQ ID NO: 39007 - DNA, 473 bp, Homo sapiens
  misc_feature 4, 5, 7, 18, 22, 25, 26, 27, 31, 33, 34, 35, 36, 38, 39,45, 47, 49, 50, 62, 71, 78: n = A,T,C or G
atgnncnaactgcttgcngagnacnnntgcngnnnncnnctgcangncnnggcatggactanatgaaacanaaatcanaaagataataatttctgaatagctgcctcctgctctctttttgttgctgaaagaaagacagaagattagacaaaagtcttttctacatgacaaccagatgcatttctgcttttaaggaggcactgtcaatttcctaagtgaagaatggtttcagcacctttctttgtccatgagctctcttttcaccaatttcttaaattatattaagttgcaaaataaaacattccaaacatttcgaaaatgtgagggatcctaacccaccaccaccacacccagctaattttgtatttttagtagagacggggtttctccatgttggtcaggcagtctcaaactccccacctcaggtgatccacccgcctcggcctcccaaagtgctgggattacaggcatga

SEQ ID NO: 39008 - DNA, 466 bp, Homo sapiens
gatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggtta

SEQ ID NO: 39009 - DNA, 436 bp, Homo sapiens
gtctcttttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaatgtttttaacac

SEQ ID NO: 39010 - DNA, 483 bp, Homo sapiens
tcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttattttcaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttc

SEQ ID NO: 39011 - DNA, 472 bp, Homo sapiens
  misc_feature 14, 271: n = A,T,C or G
gaggcattgaggcngccagcgcaggggcttctgctgagggggcaggcggagcttgaggaaaccgcagataagtttttttctctttgaaagatagagattaatacaactacttaaaaaatatagtcaataggttactaaagatattgcttagcgttaagtttttaacgtaattttaatagcttaagattttaagagaaaatatgaagacttagaagagtagcatgagggaggaaaagataaaaggtttctaaaacatgacggaggttggagnatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaa

SEQ ID NO: 39012 - DNA, 470 bp, Homo sapiens; identical to SEQ ID NO: 38838

SEQ ID NO: 39013 - DNA, 162 bp, Homo sapiens
  misc_feature 162: n = A,T,C or G
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcaaan

SEQ ID NO: 39014 - DNA, 394 bp, Homo sapiens
ctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaggagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaat

SEQ ID NO: 39015 - DNA, 195 bp, Homo sapiens
  misc_feature 15: n = A,T,C or G
aagtaaaagactggntaatgataacaatgcatcgtaaaaccttcaggaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagtt

SEQ ID NO: 39016 - DNA, 466 bp, Homo sapiens
gatctcatctatcctttacggcaagggtacctacggtacctgaaaacaacgatggcatggaaaacacttcccatttacctgttgttgctgctgtctgttttcgtgattcagcaagtttcatctcaagagctttcctgtaaaggccgctgctttgagtccttcgagagagggagggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaattt

SEQ ID NO: 39017 - DNA, 495 bp, Homo sapiens
  misc_feature 5, 6: n = A,T,C or G
cggcnnttttggccggggatctattcctttacggcaagggtaccctacggtacctgaaaacaacgatggcatggaaaacacttccctttacctgttgttgctgctgtctgttttcgtgattcagcaagtttcatctcaagagctttcctgtaaaggccgctgctttgagtccttcgagagagggaggggagtgtgactgcgacgcccaatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtctt

SEQ ID NO: 39018 - DNA, 461 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtaatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacata

SEQ ID NO: 39019 - DNA, 283 bp, Homo sapiens
gttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctgga

SEQ ID NO: 39020 - DNA, 433 bp, Homo sapiens
  misc_feature 8, 15, 33, 64, 110, 204, 250: n = A,T,C or G
gatgacancattgcnatcattgatgtgcctgtncccagtttctctgatagtgaccctgcagcanttattcatgactttgaaaagggaatgactgcttacctggacttgtntgctggggaactgctatctgatgcccctcaatacttctattgttatgcctccaaaaaatctggtagagctctttggcaaactggcgagtggcangatatctgcctcaaacttatgtggttcgagaagacctagttgctgnggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaaga

SEQ ID NO: 39021 - DNA, 100 bp, Homo sapiens
gtagatattgcaccctatgacattggtggtcctgatcaagaatttggtgtggacgttggccctgtttgctttttataaaccaaactctatctgaaatccc

SEQ ID NO: 39022 - DNA, 165 bp, Homo sapiens
  misc_feature 18, 33: n = A,T,C or G
gtacgactcttagtcggnggatcactcggctcntgcgtcgatgaagaacgcagctagctgcgagaattaatgtgaattgcaggacacattgatcatcggcacttcgaacgcacttgcggccccgggttcctcccggggctacgcctgtctgagcgtcgcttgccg

SEQ ID NO: 39023 - DNA, 325 bp, Homo sapiens
  misc_feature 188: n = A,T,C or G
aagagacagtgtttcaccatgttgcccaggcaggtctcaaactcctgggctcaagtggtcctccagcttcagcctcccaaagtgctaggattataggtgtgagccacagtgcccagccccgtagtggagaatttctgttgaatgaaccaaaagcaactgccaacctctccatgcaccatgtgtttcangaggagaaagcacagtgaagaatacagtgtgttctgaggtcctgtcacccctgaggctgtgtgtgtcctttgccaaattaaagagtcttactgaatgcggtgcatccaggagacaggcccaggtttggactggtcct

SEQ ID NO: 39024 - DNA, 452 bp, Homo sapiens
  misc_feature 15, 20: n = A,T,C or G
gatggcaacaaaatngcagnagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttatccgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgct

SEQ ID NO: 39025 - DNA, 467 bp, Homo sapiens
  misc_feature 14, 17: n = A,T,C or G
atcctactccaagnatnagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacctccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatg

SEQ ID NO: 39026 - DNA, 189 bp, Homo sapiens
caacatggtgaaaccctgtctctactaaaaatacaaaaaattagccacgagtggtggctggcacctgtaattgtgccacgggaggctgaggcaggagaatcacttgaacctggggagatggaggttgctgtgagctgagattgtgccattgcacaccagcctgggcaacaagagcaaaaccctgtcgcg

SEQ ID NO: 39027 - DNA, 468 bp, Homo sapiens
  misc_feature 7, 21: n = A,T,C or G
acagggnacaaaaataagatnacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaaagatgagttgtagacactgatctgctagtgctgtaatattgtaaatactggactcaggaacttttg

SEQ ID NO: 39028 - DNA, 102 bp, Homo sapiens
gaggctgaggcaggagaatcacttgaacatgggaggcggaggttgcagtgagcagagatcgtgccactgccctccagcctgagtgacagagtcagactctat

SEQ ID NO: 39029 - DNA, 476 bp, Homo sapiens
catacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttg

SEQ ID NO: 39030 - DNA, 416 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttg

SEQ ID NO: 39031 - DNA, 369 bp, Homo sapiens
tagatatagtaccgcaagggaaagtatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgc

SEQ ID NO: 39032 - DNA, 115 bp, Homo sapiens
ttttttgcgtgtggcagttttaagttattagtttttaaaatcagtactttttaatggaaacaacttgaccaaaaatttgtcacagaattttgagacccattaaaaaagttaaatg

SEQ ID NO: 39033 - DNA, 320 bp, Homo sapiens
gacacgcttttcatctgtcccgctgcgtgttttcctcttgatcgggaactcctgcttctccttgcctcgaaatggaccccaactgctcctgctcgcctgttggctcctgtgcctgcgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagcttgctgtgcctgatgccaggacagctgtgctctcagatgtaaatagagcaacctatataaacctggatttttttt

SEQ ID NO: 39034 - DNA, 468 bp, Homo sapiens
  misc_feature 7, 437: n = A,T,C or G
caatganaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacctccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttaggnggtttttttatttctactgtcaaatgatgtg

SEQ ID NO: 39035 - DNA, 460 bp, Homo sapiens
taggcgcctctctccctactgctgctacactagtaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaataca

SEQ ID NO: 39036 - DNA, 456 bp, Homo sapiens
gaggccttgaggcagccagcgcaggggcttttgctgagggggcaggcggagcttgaggaaaccgcagataagtttttttctctttgaaagatagagattaatacagctacttaaaaaatatagtcaataggttactaagatattgcttagcgttaagtttttaacgtaattttaatagcttaagattttaagagaaagtatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaaga

SEQ ID NO: 39037 - DNA, 488 bp, Homo sapiens
  misc_feature 9: n = A,T,C or G
gagattatncactcttaaaaaatatagtcataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatg

SEQ ID NO: 39038 - DNA, 349 bp, Homo sapiens
gtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagct

SEQ ID NO: 39039 - DNA, 490 bp, Homo sapiens
  misc_feature 34: n = A,T,C or G
agctgcaggaattgccagaaaaaatgcccatttnctcttcgggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaaca

SEQ ID NO: 39040 - DNA, 252 bp, Homo sapiens
  misc_feature 31, 63, 205: n = A,T,C or G
gcttagcgttaagtttttaacgtaattttantagcttaagacttttaagagaaaatatgaagncttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccantagaagggcaatgcttttagattaaaatgaaaggtgacttaaacagc

SEQ ID NO: 39041 - DNA, 272 bp, Homo sapiens
tgtggtggctcacgcctgtaatcccagcacttcgggaggccgaggtgagtggatcatgaagtcagatcgaaaccatcctggctaacacagtgaatccccatctcgactaaaaatacaaaaaattagccagatgtggtggtgggcgcctgtagtcccagctactcaggaggctgaggcaggagaatggcgtgaacccggggtcgggggagcttgcagtgagctgagattgtgccactgcactccagcctgggcgacagagcgagactctgtct

SEQ ID NO: 39042 - DNA, 466 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagtacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 39043 - DNA, 260 bp, Homo sapiens
tgcagtggctcacgcctgtaatcccaaaactttgggaggccgaggtgggcagatcacccgaggtcaggagttcgagaccggcctggccgacatggagaaaccccatttctactaaaaatacgaaaattagccgggtgtgatagcatgcgcctgtaatccctgaggcaggagaatcacttgaacctgggaggcggaggttgcagtgacctgacatcacgccactgcactccagcctgggcaacagggcaagactccatctc

SEQ ID NO: 39044 - DNA, 227 bp, Homo sapiens
gaggctttgaggcagcccgcgccggggccttctgctgagggggcaggcggagcttgaggaacccgcagataagtttttttctctttgaaagatagaagattaatacaactaccttaaaaaatatagtcaataggttactaagatattgcttagcgttaagtttttaacgtaattttaatagcttaagattttaagagaaaatatgaagacttagaagagtagcatga

SEQ ID NO: 39045 - DNA, 127 bp, Homo sapiens
  misc_feature 28, 43: n = A,T,C or G
taaggtgccgggcgcaggaactgtgtgngtcctacacaatggngctattctgtgtcaaacacctctgtattttttaaaacatcaattgatattaaaaatgaaaagattattggaaagtacaaaaaag

SEQ ID NO: 39046 - DNA, 464 bp, Homo sapiens
  misc_feature 425, 436, 442: n = A,T,C or G
tgcttagcgttaagtttttaacgtaattttaactagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttgaaatccatgacgcagggagaattgcgtcatttaaagcctagttaacgcatttactaaacgcagacgaaaatggaaagatnattggggagtnggtaanggatgaaacaatttgggagaag

SEQ ID NO: 39047 - DNA, 417 bp, Homo sapiens
ctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctg

SEQ ID NO: 39048 - DNA, 324 bp, Homo sapiens
  misc_feature 4: n = A,T,C or G
gacncgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttt

SEQ ID NO: 39049 - DNA, 471 bp, Homo sapiens
  misc_feature 293: n = A,T,C or G
agctactcgggaggctgaggcgggaggatcgcttgggcctgggaggcggaggttgcagtgagccgagatggcactactgcactccagcctgggtgtcggagcaggactctgtctcaaaaaggaaaagaaatgatgtaacatggcaccctggatgggattgtggatgagaaaatgcatattaggtagaaattaaggaaatctgaataatgtatggacttcaaattgtaagtatcagtatggttttattggttatgctacaataatgttgaaatggaggatattgggtacagggnttagaagaacttcctgtaatattcttacaatttttctgtaaacctgaaactaacctaaagtaaaaagtttattaaatcttaagaaaatcagagattgaacaattaaataccacattaaaaaaaagggaaaggaaatcttggtatctgataaggtaacattcataaccaaaaaagtatt

SEQ ID NO: 39050 - DNA, 454 bp, Homo sapiens
cccaaactccccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagttagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcat

SEQ ID NO: 39051 - DNA, 110 bp, Homo sapiens
ataggcgatagaaattgaaacctggcgcaatagatatagtaccgcaagggaaagatgaaaaattataaccaagcataatatagcaaggactaacccctataccttctgcg

SEQ ID NO: 39052 - DNA, 468 bp, Homo sapiens
gctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattaggttaaaaatactaaaaagagttccttagagtaatcatttcaaccaaatgaatttcaagcaacaacttacttactatttatcaaaaag

SEQ ID NO: 39053 - DNA, 382 bp, Homo sapiens
  misc_feature 9, 12, 30, 45, 90: n = A,T,C or G
tgtaacttnacnggcctaaaatgtttctanaaattagagtttgtnactttcttccctttgtacctaagagataaataggctcagttaganaaggactccctggccaggcgcagtgacttacgcctgtaatctcagcactttgggaggccaaggcgggcagatcacgaggtcaggagttcgagaccatcctggccaacatggtgaagccccgtctctgctagaaatataaaaattagctgggtgtggtggcaggagcctgtaatcccggctacacaggaggctgaggcacgagaatcgcttgaactcaggagatggaggtttcagtgagccaagatcacaccactgcactccagcctggcaacagagcgagactccatctcga

SEQ ID NO: 39054 - DNA, 394 bp, Homo sapiens
  misc_feature 67, 109, 145, 168, 187, 193, 204, 224, 269, 277, 287, 306,314, 348, 364, 370, 393: n = A,T,C or G
ctacaaaaagaactagaagtatcacaactgtcacaaccttccggaaggagtagctgacctgacacanattgatgtcaatgtccaggatcatttctgggatgggaagggntgtgaggatgatctgttactgcaacttcagcgaatngctctgctgcccaaaagacgttntctttggaccaaagatctntttcgngattccttgcnacaatcaatgagaatcttcntgtattctggagaacaccattcctgatttcccacaaactgcactncatcagtntaactgcatnctctagtttctatataagngcaatagnagcatagattctataaattcttacttggctaagnacaagtaaatctgtgntaaacnagtagtaataaaagttaattcant

SEQ ID NO: 39055 - DNA, 449 bp, Homo sapiens
  misc_feature 9, 23, 39, 42, 44, 81, 87, 89, 96, 100, 101: n = A,T,C or G
aaataaaancgaaatgaagatgnactgatgacgatgccncantnaaatgatgaactgagatgtgatgagatgaaatgatgncatganantgatganatgnnatgagatgacatgaaataatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgatgagatgaaatgaggtgaaatgaacttagatgaaatgtaatgagatgaaatgaaatgacataatgaaatgaaataatgaaatgagatgaaataaaataatgaaatgatgaaataatgaaatgaaaatgaaatggaaatgatgagatgagaagaaatgatgagatgaaatgatgaaatgatgagatgagac

SEQ ID NO: 39056 - DNA, 435 bp, Homo sapiens
gaaatgaaatggtgagatgaaatgatgagatgaaatgaaatagtgaaatgaaattgaaataaaatcgaaatgagatgaaatgatgagatgatgaaataaaatgatgaaatgagatgtgatgagatgaaatgatgacctgaaatgatgagatgagatgagatgacactgaaataatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgatgagatgaaatgaggtgaaatgaacttagatgaaatgtaatgagatgaaatgaaatgacctaatgaaatgaaataatgaaatgagatgaaataaaataatgaaatgatgaaataatgaaatg

SEQ ID NO: 39057 - DNA, 472 bp, Homo sapiens
  misc_feature 9: n = A,T,C or G
cagcttacnaacgacaaagcccgcgtcgaggtggagcgcgacaacctggccgaggacatcatgcgcctccgggagaaattgcaggaggagatgcttcaagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccacttgagta

SEQ ID NO: 39058 - DNA, 305 bp, Homo sapiens
  misc_feature 4, 88: n = A,T,C or G
gttngcgaatttgaaatcttgatgaccacagagctgggaaaattgttgtgaacctcacaggcaggctaaacaagtgtggggtgatcanccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgctt

SEQ ID NO: 39059 - DNA, 350 bp, Homo sapiens
  misc_feature 1, 15, 27, 28, 36, 55, 64, 77, 80, 86, 89, 101, 104: n = A,T,C or G
ntttccggcggtgancgacctacgcanncgagtaanctgccctctcgcaaagganctccttcantccctctccagangangaagangangaaacacaaganganacgcctggtgcagaagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggatt

SEQ ID NO: 39060 - DNA, 500 bp, Homo sapiens
  misc_feature 8, 10, 33, 47: n = A,T,C or G
ctcggccntntctggccgggccccctttcctcntttacctttcgtgnagtttcttttcccttaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaaagagtttcacaaatc

SEQ ID NO: 39061 - DNA, 470 bp, Homo sapiens; identical to SEQ ID NO: 38838

SEQ ID NO: 39062 - DNA, 473 bp, Homo sapiens
aagccaaagacaaaaaaaattttactacttttgagattgccccaatgtacagaattatataattctaacgcttaaatatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttatttacagccagaaagtgtgggctgaagatggttggtttcatgtttttgtattatgtatctttttgtatgggaaagactatattttgtacttaaccagatatattttt

SEQ ID NO: 39063 - DNA, 470 bp, Homo sapiens
gcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggggagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattgggatgaattccaaattctgcttgcttgctttttaatat

SEQ ID NO: 39064 - DNA, 463 bp, Homo sapiens
  misc_feature 320, 341, 350: n = A,T,C or G
cttttggaagagttagaagaatttggaaggccttaaatattagtagcttagtttgaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtnttggagaatttttagaagatnggaaaaatnttaaagccaaaaattggataaaatagcactgaaaaaatgaggaaattatttggtaaccaatttattttaaaagcccatcaatttaatttctggtggtgcagaaatttagaaga

SEQ ID NO: 39065 - DNA, 108 bp, Homo sapiens
cggaaggctgaggtaggagaatcgcttgaacccgggaggtggaggttgcagtgagccaatatcatgccaccgtactccagcctgggcaacagagcaagactccatctc

SEQ ID NO: 39066 - DNA, 411 bp, Homo sapiens
tagcgttaagtttttaacgtaattttactagcttaagacgtttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagtttaaaagttgttaggtgattaaaataattttggaaggcgatcttttaaaaagagattaaaccgaaggtgattaaaagaccttgaaatccatgacgcagggagaattgcgtcatttaaagcctagttaacgcatttactaaacgcagacga

SEQ ID NO: 39067 - DNA, 291 bp, Homo sapiens
  misc_feature 4, 17, 46, 59: n = A,T,C or G
tccntactaccctgccnccccccctcttaactcagtggtggaaganccggtctcagaancctgtttgtttcaattggccttttaagtttagtagtaaaagactggttaatgataacaatgcatcgtaaaaccttcagaaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 39068 - DNA, 274 bp, Homo sapiens
cacagtggttcacgccctataatcccagcactctgggaggccaaggcaggtggatcataaggtcaggagttcaagaccagcctggccaatatggtgaaaccctgtctctactaaaaaatacaaaaattagccaggcatggtggcacgtgcctatagtcccagctactcaggatgctgaggcaggagaatcgctggaacccaggaggcgggaggttgcggtgagccaagatgctctactgcactccagcctgggtgacagagacagactccatcg

SEQ ID NO: 39069 - DNA, 469 bp, Homo sapiens
gctctttccgcctctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattcttttttaggggatgtaatcattatatttacaaattaaaatgcctcatggactcgc

SEQ ID NO: 39070 - DNA, 342 bp, Homo sapiens
  misc_feature 20: n = A,T,C or G
tgcaggatgaagattcagantatgaaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgggggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatatta

SEQ ID NO: 39071 - DNA, 397 bp, Homo sapiens
aagtatctcactcaaggtgatacagctaatagtggcacagccaggattcagacctggacgatcctaagtttccatttcctaatctgaaaacagagatagccatactcagctcctaaaagtactaccccctcactgtaactaaatgattcaatgtatgtaaaatgccttatacataacaagtactagaaacgtttgttctgtgttctcttttccttctctttccttcccattcccatttctgattacagggaatttacataactttaaaagtgactattcggccaggcgcagtggctcacgcctgtaatcccagcactttgggaggccgaggcaggcagaacacgaggtcaggagttcgaaaccagcccgaccaacatggtgaaaccctgtctctact

SEQ ID NO: 39072 - DNA, 163 bp, Homo sapiens
  misc_feature 162, 163: n = A,T,C or G
acgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccnn

SEQ ID NO: 39073 - DNA, 472 bp, Homo sapiens
gaaatccggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggagggaaatggctcgtcaccttcgtgaataccaagacctgctcaatgttaagatggcccttgacattgagattg

SEQ ID NO: 39074 - DNA, 111 bp, Homo sapiens
cgcagtgggtcacacctgtgatcccagcacttcgggaggccaaggcaggcagatcacgagatcaggagtttgagaccagcctggccaacgtagtgaaaccctgtctctact

SEQ ID NO: 39075 - DNA, 258 bp, Homo sapiens
agagaagatagggaaattagaagataaaaacatacttttagcaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaag

SEQ ID NO: 39076 - DNA, 427 bp, Homo sapiens
catgcaagttaccaaaactgtgataacccttttttacttactgtagagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttct

SEQ ID NO: 39077 - DNA, 160 bp, Homo sapiens
gtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgctt

SEQ ID NO: 39078 - DNA, 433 bp, Homo sapiens
  misc_feature 33, 58, 431: n = A,T,C or G
cagactctccacctttgggtcgctttgctgttngtgatatgagacagacagttgcggngggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaantg

SEQ ID NO: 39079 - DNA, 458 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccg

SEQ ID NO: 39080 - DNA, 275 bp, Homo sapiens
  misc_feature 9, 49, 174: n = A,T,C or G
agcttaagnaattgctaggattaaattaaggaaagtaaagctacccagnagcagcaggttccacaagcacaaactttacacatttgtacaattttgaaatgcactacaataaacaaattagagcaacacatttgaaatacaggcttctttacataaactgagaggttatacaanaactcagtttcacaagggaacaatctatacctttctaaaagttaatatttcaagtctctaataggcagaatattttactctttaaaatcctgcctttctga

SEQ ID NO: 39081 - DNA, 343 bp, Homo sapiens
gctttccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgt

SEQ ID NO: 39082 - DNA, 104 bp, Homo sapiens
ctagtttctatatagtgcaatagagcatagattctataaattcttacttgtctaagacaagtaaatctgtgttaaacaagtagtaataaaagttaattcaatct

SEQ ID NO: 39083 - DNA, 353 bp, Homo sapiens
aaagattaattgggagtggtaggatgaaacaatttggagaaggtagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagacagaaaatgaaaatattgtcaagagtttcagatagaaaatgaaaaacaagctaagacaagtattggagaagtatagaagatagaaaaatat

SEQ ID NO: 39084 - DNA, 384 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccggcagagaatggaaggtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgaga

SEQ ID NO: 39085 - DNA, 456 bp, Homo sapiens; identical to SEQ ID NO: 28954

SEQ ID NO: 39086 - DNA, 317 bp, Homo sapiens
gaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcggtgagggtcaaaggagagtcaacatatgtgattgttccataataaacttctggtgtgaga

SEQ ID NO: 39087 - DNA, 475 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgatt

SEQ ID NO: 39088 - DNA, 156 bp, Homo sapiens; identical to SEQ ID NO: 34105

SEQ ID NO: 39089 - DNA, 265 bp, Homo sapiens
attggcccctcactgcagctgccagcacttggtcagtcactctcagcctagcactttgttcactgtcctgtgtcagagcactgagctccacccttttctgagagttatttacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaat

SEQ ID NO: 39090 - DNA, 468 bp, Homo sapiens
  misc_feature 462: n = A,T,C or G
gattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaatctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtnttggag

SEQ ID NO: 39091 - DNA, 245 bp, Homo sapiens
  misc_feature 19: n = A,T,C or G
tcacatttggatgattgtnataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactg

SEQ ID NO: 39092 - DNA, 193 bp, Homo sapiens
gaatcttagttcaactttaaatttgcccacagtaaccctctaaatccccttgtaaatttaactgttagtccaaagaggagcagctctttggacactaggaaaaaaccttgtagagagagtaaaaaatttaacacccatagtaggcctaaaagcagccaccaattaagaaagcgttcaagctcaacacccacta

SEQ ID NO: 39093 - DNA, 442 bp, Homo sapiens
  misc_feature 66, 105, 108, 209, 323, 328, 360: n = A,T,C or G
gagaagagggagaaagcagcatcttgcctggatgagccaggggacacagaagagaagcccactatntcatttaatctttacaactctcttgcaaggttccctggntgngaaaatacatgagataaatcatgaaggccacctatcatcctccttctgcttgcacaagtttcctgggctggaccgtttcaacagagaggcttatttgactntatgctagaagatgaggcttctgggataggcccagaagttcctgatgaccgcgacttcgagccctccctaggcccagtgtgccccttccgctgtcaatgccatcttcgagtggnccagngttctgatttgggtctggacaaagtgccaaangatcttccccctgacacaacctctgctagacctgcaaaacaacaaaataaccgaaatcaaagatggagactttaagaacctg

SEQ ID NO: 39094 - DNA, 467 bp, Homo sapiens
  misc_feature 7: n = A,T,C or G
caaaganggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggat

SEQ ID NO: 39095 - DNA, 292 bp, Homo sapiens
ctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatatgaacctggattttttttttttttt

SEQ ID NO: 39096 - DNA, 113 bp, Homo sapiens
  misc_feature 37: n = A,T,C or G
agtgaaacttttctagaattatttttcactctaagtnatgtatgtttctctttgattatttgcatgttatgtttaataagctactagcaaaataaaacatagcaaatggcgag

SEQ ID NO: 39097 - DNA, 471 bp, Homo sapiens
  misc_feature 218, 229, 275, 283, 324, 367, 385: n = A,T,C or G
gtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttttctatanacttttttcanataacatcttctgagtcataaccagcctggcagtatgatggcctanatgcaganaaaacagctccttggggaattgataagtaaaggcagaaaanattatatgtcatacctccattggggaataagcataaccctganattcttactactgatganaacattatctgcatatgccaaaaaattttaagcaaatgaaagctatcaatttaaagttacggaatctaccattttaaagttaattg

SEQ ID NO: 39098 - DNA, 413 bp, Homo sapiens
  misc_feature 32: n = A,T,C or G
aacacaatccgttgcaaacccaaaggacccangtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattat

SEQ ID NO: 39099 - DNA, 135 bp, Homo sapiens
  misc_feature 29: n = A,T,C or G
actgtacggagaaactcaaaccttcaagnccctaggtgtagccattttgtcaagtcatcaactgtatttttgtactggcattaacaaaaaaagagataaaatattgtaccattaaactttaataaaactttaaaa

SEQ ID NO: 39100 - DNA, 468 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttat

SEQ ID NO: 39101 - DNA, 469 bp, Homo sapiens
atataaagtctcaaaactggcagatgaataattagacagtaaaattattaagcaaaacaaggaaattattattataaaaagttagaatagtagttacctttgggggtggggggaaatgagggatattactggaataaagcacttgagaattttcatagaaaaaaagtaaggaaaagcactcccagggttaaatatacattgctcacatttatgtcttctacctctgtatctatatctgtaatatttcataatggtaattgatgactcagaggcatgaaaatatccagaattattttaagaattaattagtaactaataattatcatctataggctttagttacttgaacatagcaggaaagtagcagacaaattttggttaacatagttcaaaaagcatttttcttgcttaacccttagttaagaattaaaatataggccagatgcagtggttcatgcctataatccca

SEQ ID NO: 39102 - DNA, 176 bp, Homo sapiens
attgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaat

SEQ ID NO: 39103 - DNA, 461 bp, Homo sapiens
gcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatag

SEQ ID NO: 39104 - DNA, 464 bp, Homo sapiens
caacagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatg

SEQ ID NO: 39105 - DNA, 404 bp, Homo sapiens
  misc_feature 8, 178, 179, 393: n = A,T,C or G
atgctgantctcattcgatgctgtaacctccatgaaggtaagaaccatgtctgttttacttactgctgtgtccctagaccttagcaggtcttaactcatagtaatggtcaataagtatttgttgaatgattaaatgaatttttcttgtccactaaagactttcctgtatttcatactnnaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaaatctggcccgggtgtggtggctcacgcctgtagncccggcacttt

SEQ ID NO: 39106 - DNA, 118 bp, Homo sapiens
  misc_feature 73, 84, 92: n = A,T,C or G
agttcagcttgaatgtctcttagagggtgggcttttgttgatgagggaggggaaactttttttttttctatanacttttttcanataacatnttctgagtcataaccagcctggcagt

SEQ ID NO: 39107 - DNA, 456 bp, Homo sapiens; identical to SEQ ID NO: 28954

SEQ ID NO: 39108 - DNA, 195 bp, Homo sapiens
agagcaagaccttgtctctgcaaaaaattttttaaaaattagctgagtatagtggcacacacctgtagtcccagctacttgggaggctaaggcaggaggaggatcacgtgagctcaggaatttgaggctgcaatgagttatggtgacaccactgcactccagagtgagaccctgtctccaaaaaacaaacaaaca

SEQ ID NO: 39109 - DNA, 190 bp, Homo sapiens
actgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaat

SEQ ID NO: 39110 - DNA, 473 bp, Homo sapiens
agatagtttttttctctttgaaagatagagattaatacaactacttaaagaatatagtcaataggttactaagatattgcttagcgttaagtttttaacgtaattttaatagcttaagattttaagagaaaatatgaagacttagaagagtagcatggggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcattta

SEQ ID NO: 39111 - DNA, 470 bp, Homo sapiens
acaaaaccctcaaggccgggaagacagacttgcagtttccagtcaccccaagctgtgcctggtcaccttgaggatcagtatcccaaaacacttgaacttgcttttgacccaccagttgggaagcggcagcaaattgcaaacttcttgggacaggaatttagacgttgtatctccagggccttgatcaactggctgttaaccacataggtgctcaagaaatgtttgcttactgaagttgtgacaaggcagccatagaaattcattgtgaagttaaatgactttaaggtaggaatatgttagtaactactactaacatagttagttacaaactactctttgtattaaagttggagtactgaagttgctttcttccattgtgtctttcttttaccaaatttcatgttaaagataaagggggaataggccagcgcgatggctcacgcctgtaatcccagcactttgggaggctg

SEQ ID NO: 39112 - DNA, 301 bp, Homo sapiens
gcacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatat

SEQ ID NO: 39113 - DNA, 161 bp, Homo sapiens; identical to SEQ ID NO: 38841

SEQ ID NO: 39114 - DNA, 472 bp, Homo sapiens
  misc_feature 16: n = A,T,C or G
atggataggaagaatnaatatcatgaaaatggccctactgcccaaagtagtttatagattcaatactattcccatcaagctaccattgactttcttcacagaattagaaaaaactacttcaaatttcatatggaactaaaaaagagcccgtatagccaagacagtcctgagcaaaaagaacaaagctggaggcatcacactacctgacttcaaactatactacaaggctattactggtaccaaaacagatataaagaccaatggaacataacagaggcctcagaaataataccacacatatacaaccatctgatttttgacaaacctgacaaaaacaagcaatggggaaaggatttcctatttaataaatgggtgttgggaaaactggctagccatatgtagaaaagtgaaactggaccccttccttacaccttatacaaaaattaactgaaggtggattaaagatttaaat

SEQ ID NO: 39115 - DNA, 469 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttata

SEQ ID NO: 39116 - DNA, 205 bp, Homo sapiens
  misc_feature 38, 43: n = A,T,C or G
aggcttaaaaacagatgcaattcccggacgtctaaacnaaacnactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagc

SEQ ID NO: 39117 - DNA, 473 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagc

SEQ ID NO: 39118 - DNA, 353 bp, Homo sapiens
agggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattaccgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttca

SEQ ID NO: 39119 - DNA, 456 bp, Homo sapiens
  misc_feature 200: n = A,T,C or G
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtngggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 39120 - DNA, 217 bp, Homo sapiens; identical to SEQ ID NO: 29192

SEQ ID NO: 39121 - DNA, 127 bp, Homo sapiens
catggtgaccacgggtgacggggaatcagggttcgattccggagagggagcctgagaaacggctaccacatccaaggaaggcagcaggcgcgcaaattacccactcccgacccggggaggtagtgac

SEQ ID NO: 39122 - DNA, 472 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagttaaaagttgtaaggtgattaaaataattttggaaggcgatcttttaaaaagagattaaacccgaag

SEQ ID NO: 39123 - DNA, 289 bp, Homo sapiens
gaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacca

SEQ ID NO: 39124 - DNA, 472 bp, Homo sapiens
atcccatgcaacaacaagggagctcactcagtgggtttgatgtggtggatgctggctcgggaagttctgcgcatgcgtggcaccatttcccgtgaacacccatgggaggtcatgcctgatctgtatttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatgggttgatgggaaaataaacattcag

SEQ ID NO: 39125 - DNA, 275 bp, Homo sapiens
gattgaagcccccattcgtataataattacatcacaagacgtcttgcactcatgagctgtccccacattaggcttaaaaacagatgcaattcccggacgtctaaaccaaaccactttcaccgctacacgaccgggggtatactacagtcaatgctctgaaatctgtggagcaaaccacagtttcatgcccatcgtcctagaattaattcccctaaaaatctttgaaatagggcccgtatttaccctatagcaccccctctaccccctctagagac

SEQ ID NO: 39126 - DNA, 276 bp, Homo sapiens
catggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctc

SEQ ID NO: 39127 - DNA, 412 bp, Homo sapiens
aaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 39128 - DNA, 318 bp, Homo sapiens
taaccagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacacta

SEQ ID NO: 39129 - DNA, 465 bp, Homo sapiens
aaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttct

SEQ ID NO: 39130 - DNA, 465 bp, Homo sapiens
  misc_feature 11, 21: n = A,T,C or G
aacagaacagnaggcctcagnaaataatgccacacatctacaaccatctgatctttgacaaacctgacaaaaacaaggaatggggaaagggtattctatttaataaattatgttaggaaaactggctagccatgtgcagaaaactgaaactggaccccttccttacaccttatataaaaattaactcaagatggattaaagacttaaacataagacctaaaaccataaaaaccctaggaaaaaatcttggcaatgccattcaagacataggcatgggcaaagatttcatggctaaaacaccaaaagcaatggcaacaaaggccaaaattgacaaatgggatctaattaaactaaagagcttctgcacagcaaaagaaactatcatcagagtgaaaagactacctacagaatgagaaaaattttgcaatctgtccatctgagaaaggtctaatatccagaatctac

SEQ ID NO: 39131 - DNA, 465 bp, Homo sapiens
  misc_feature 385: n = A,T,C or G
tctttgtggctccggaaaagcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggangatgggcccgttgtgattggctctaccagtgcacctggacagggaggaatcctggctcagcgggagtttgacaggcgatt

SEQ ID NO: 39132 - DNA, 288 bp, Homo sapiens
gagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 39133 - DNA, 418 bp, Homo sapiens
ttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagat

SEQ ID NO: 39134 - DNA, 468 bp, Homo sapiens
  misc_feature 26, 32: n = A,T,C or G
acccttttacaagaatggcgccgaangcgaancaaggaagctcctgcccctcctaaagctgaagccaaagcgaaggctttaaaggccaagaaggcagtgttgaaaggtgtccgcagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaac

SEQ ID NO: 39135 - DNA, 165 bp, Homo sapiens; identical to SEQ ID NO: 38735

SEQ ID NO: 39136 - DNA, 220 bp, Homo sapiens
  misc_feature 33, 218: n = A,T,C or G
gaggcactgaggcagccagcgcaggggcttctnctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtngc

SEQ ID NO: 39137 - DNA, 460 bp, Homo sapiens
  misc_feature 9: n = A,T,C or G
cgcaatagnatatagtaccgcaagggaaagtatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 39138 - DNA, 444 bp, Homo sapiens
agattaaaatggaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagatgaaaacatacttttagaagaaaaaagataaatttaaacctgaaaagtaggaagcagaagaaaaaagacaagctaggaaacaaaaagctaagggcaaaatgtacaaacttagaagaaaattggaaga

SEQ ID NO: 39139 - DNA, 120 bp, Homo sapiens
  misc_feature 5: n = A,T,C or G
aaggnggaccacctgagtcaccagaggatgagagtgccaagctgggcttcgaggcccactggttctgggagcagtgccaggatgatgtgaccttcttgtaacaactattccacccttttg

SEQ ID NO: 39140 - DNA, 482 bp, Homo sapiens
  misc_feature 16: n = A,T,C or G
gacccttttcacaagnatggcgccgaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaaagaaggcatatgttcgactggctcctgattacgatgctttggatgttgccaacaaaattgggatca

SEQ ID NO: 39141 - DNA, 461 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcgaataccttcatatcccctcagcagagatggagagctaaagtccaagagaggatccgagaacgctctaagcctgtccacgagctcaatagggaagcctgtgatgactacagactttgcggacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacata

SEQ ID NO: 39142 - DNA, 479 bp, Homo sapiens
gacaaccttagccaaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagcca

SEQ ID NO: 39143 - DNA, 457 bp, Homo sapiens
cattcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactat

SEQ ID NO: 39144 - DNA, 311 bp, Homo sapiens
  misc_feature 7, 34, 308: n = A,T,C or G
gattcgncagggaagctgacatccacaccaagtngagtacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagcctcanatg

SEQ ID NO: 39145 - DNA, 171 bp, Homo sapiens
ccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttg

SEQ ID NO: 39146 - DNA, 326 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatggagcaacctatataaacctggatttttttttttttt

SEQ ID NO: 39147 - DNA, 392 bp, Homo sapiens
  misc_feature 6: n = A,T,C or G
accttncccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggtttgatggaaaataaacatcagtttc

SEQ ID NO: 39148 - DNA, 168 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccaggttcctcccggggctacgcctgtctgagcgtcgcttgccgaag

SEQ ID NO: 39149 - DNA, 465 bp, Homo sapiens
  misc_feature 5: n = A,T,C or G
cgcantagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 39150 - DNA, 464 bp, Homo sapiens
gatagcaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctgtgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctc

SEQ ID NO: 39151 - DNA, 248 bp, Homo sapiens
gtactttgggaggctgaggcaggtggatcacctgaggaaaggagttcgagaccagcctggccaacatggtgaaaccccatctctactaaaaatataaaaattagccaggtgtggtggcgggcgcctgtaatcccagctattcgggaggctgaggcacgagaatcgcttgaacccagcagcagagggtgcgggtgagccaagattgcaccactgcactccagcctgggtgacagattgagactccatct

SEQ ID NO: 39152 - DNA, 374 bp, Homo sapiens
gcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactattttctgtatgtctccatctattgatgagggtcttaga

SEQ ID NO: 39153 - DNA, 464 bp, Homo sapiens
  misc_feature 14: n = A,T,C or G
attgaatgtaaagnaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccat

SEQ ID NO: 39154 - DNA, 465 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 39155 - DNA, 309 bp, Homo sapiens
  misc_feature 11, 309: n = A,T,C or G
gatggcctagnatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcn

SEQ ID NO: 39156 - DNA, 454 bp, Homo sapiens
gggccaaagccaaatgaaactgatggtacttgttttaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaaatctgtg

SEQ ID NO: 39157 - DNA, 221 bp, Homo sapiens
  misc_feature 14: n = A,T,C or G
gaggccttgaggcngccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcac

SEQ ID NO: 39158 - DNA, 106 bp, Homo sapiens; identical to SEQ ID NO: 27192

SEQ ID NO: 39159 - DNA, 223 bp, Homo sapiens
gaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 39160 - DNA, 472 bp, Homo sapiens
gctaacctagccccaaacccactccccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtaga

SEQ ID NO: 39161 - DNA, 470 bp, Homo sapiens
agcatttaagaagcatcctctgccagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctata

SEQ ID NO: 39162 - DNA, 471 bp, Homo sapiens
  misc_feature 6: n = A,T,C or G
atagtnataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgatgcagggagaattgcgtcatttaaagcctagttaacgcatttactaaacgcagacgaaaatggaaagattattgggagtggtaggatgaaacaat

SEQ ID NO: 39163 - DNA, 188 bp, Homo sapiens
caggcagtgacagccccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattccg

SEQ ID NO: 39164 - DNA, 481 bp, Homo sapiens
gaatgtgataagttctttaaaagaggtaagagcaacgtgctttgggagcagagaagagggagaaagcagcatcttgcctggatgagccaggggacacagaagagaagcccaccatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagacttt

SEQ ID NO: 39165 - DNA, 469 bp, Homo sapiens
  misc_feature 54, 99: n = A,T,C or G
aaggagcctctctccctactgctgctacacaagaccctgagaactgacctgcangacgaaaaccatgaagagcctgatccttcttgccatcctggccgncttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 39166 - DNA, 469 bp, Homo sapiens
aagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggagaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatc

SEQ ID NO: 39167 - DNA, 156 bp, Homo sapiens
tggcacttgcctgtaatcctagctacttgagaggctgaagcaggagaatctcttgaaccttggaggcataggttgcagtgagccgagattgcaccattgcactccagcctcggggacaagagcaagactttgtttcaaaaaaaccaaaccaaaccg

SEQ ID NO: 39168 - DNA, 401 bp, Homo sapiens
  misc_feature 398, 400: n = A,T,C or G
ataggaccatttttatttgcagcttgagtttttatatgaagttgcattattgtggacttggctgtcttgtgatgaatttttttcatatgtattctgtgccatactactgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactactaaacaccttgtttacagacagatgaaataaatttattccaaccnant

SEQ ID NO: 39169 - DNA, 363 bp, Homo sapiens
atatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaa

SEQ ID NO: 39170 - DNA, 220 bp, Homo sapiens
ctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaagtttaacacccatagtaggcctaaaagcagccaccaattaagaaagcgttcaagctcaacacccactacg

SEQ ID NO: 39171 - DNA, 335 bp, Homo sapiens
  misc_feature 4, 37, 41, 42, 96, 129: n = A,T,C or G
attnggccgggatccccaccgcccttacgaacaagantaanncggatgggtggttcctgctgccctcaaggtcgtgcgtctgaagcctacaagaanagtttgcctatctggggcgcctggctcacgaangttggctggaagtaccaggcagtgacagccaccctggagggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctc

SEQ ID NO: 39172 - DNA, 469 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatgggtacaatgctgcctataatcgctacttcaggaagcgccgagggaccaaatgagactgagggaagaaaaaaaatctctttttttctgggaggctggcacctgattttgtatccccctgtagcagcattactgaaatacataggcttat

SEQ ID NO: 39173 - DNA, 425 bp, Homo sapiens; identical to SEQ ID NO: 38856
  misc_feature 5, 10: n = A,T,C or G

SEQ ID NO: 39174 - DNA, 360 bp, Homo sapiens
  misc_feature 11, 15, 45, 63, 165, 335: n = A,T,C or G
agccttggagngaanacccgcagacaaagtttttttctctttganagactagagacttaactncaacctaccttaaaaactctagtcaactaggttacctaaagactcttgcttagcgttaagtttttaacgtaattttaatagcttaagacttttaagagaaantatgaagacttagaagagtagcatgaggaaggaaaagctaaaaggtttctaaaaccgacggaggttgagatgaagcttcttcatggagtaaaaaatgtatttaaaagaaaattgagagaaaggactacagagccccgaattaataccaatagaagggcaatgcttttagnttaaatggaagggtgacttaaacag

SEQ ID NO: 39175 - DNA, 473 bp, Homo sapiens
gaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtggaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatgggggctttccagggaatg

SEQ ID NO: 39176 - DNA, 276 bp, Homo sapiens
  misc_feature 8, 12: n = A,T,C or G
accgtgangatngtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 39177 - DNA, 165 bp, Homo sapiens
tggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatat

SEQ ID NO: 39178 - DNA, 455 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcagcacccacta

SEQ ID NO: 39179 - DNA, 333 bp, Homo sapiens
tataccagctaatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggcgatagctggttgtccaagatagaatcttagttcaactttaaatttgcccacagaaccctctaaatccccttgtaaatttaactgttagtccaaagaggaacagctctttggacactaggaaaaaaccttgt

SEQ ID NO: 39180 - DNA, 391 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatacccatagaagggcaatgcttttagattaaaatgaaggtgacttaaac

SEQ ID NO: 39181 - DNA, 226 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgagc

SEQ ID NO: 39182 - DNA, 470 bp, Homo sapiens
  misc_feature 9, 11: n = A,T,C or G
gacaacagnanacatcaaggaaattcttagaaattaaaaatatagtttttaagaccaaaacactcagaatgacagaatagtcatactggagaccacattcataatatgaagaaaaagtaaaaggaatcttcaagagagtagaatattaagacatgcagaaaatatgagaagaaaaatttgaagtcatagagaaagaaaaaaagaaaaaaaatagagaaaatgtacctttctaaaaagctttggtctttagatcaaaaaggcccacctaggctgggtgcagtggctcactcctataatctcgatactttggaaggccaaggtgggaggatcacttgagcacaggacttcaagactcagtatgtgcaacacactgagaacttatctctaccaaaaaaaagtaaataaataaataaaagtagcctggtatgggtggctcatgcctgtagtcctagctacttgggaggctgaag

SEQ ID NO: 39183 - DNA, 289 bp, Homo sapiens
  misc_feature 29: n = A,T,C or G
aagggatgtgagatgatctgttactgcancttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatccg

SEQ ID NO: 39184 - DNA, 225 bp, Homo sapiens
  misc_feature 19, 34: n = A,T,C or G
gatagctggttgtccaagnatagaatcttagttnaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaat

SEQ ID NO: 39185 - DNA, 165 bp, Homo sapiens
  misc_feature 10: n = A,T,C or G
aaaccgcagnataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcat

SEQ ID NO: 39186 - DNA, 435 bp, Homo sapiens
  misc_feature 14, 32: n = A,T,C or G
catcacctgcaggnaaacaagtttcacaaaantaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttg

SEQ ID NO: 39187 - DNA, 185 bp, Homo sapiens
ctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggta

SEQ ID NO: 39188 - DNA, 418 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaggataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgta

SEQ ID NO: 39189 - DNA, 411 bp, Homo sapiens
  misc_feature 33: n = A,T,C or G
caagcataatatagcaaggactaacccctatancttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 39190 - DNA, 286 bp, Homo sapiens
gaagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 39191 - DNA, 296 bp, Homo sapiens
  misc_feature 33: n = A,T,C or G
caagctcaacacccactacctaaaaaatcccanacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaaagtaaaaggaactcggcaaatcttaccccgcctgttta

SEQ ID NO: 39192 - DNA, 465 bp, Homo sapiens
cgcactagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 39193 - DNA, 418 bp, Homo sapiens
agatcgcggaacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccaggaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatga

SEQ ID NO: 39194 - DNA, 292 bp, Homo sapiens
gcagagtgggttggctggagttcattgcggagcatgaggacgtgtgggggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggatttgttggctcagat

SEQ ID NO: 39195 - DNA, 418 bp, Homo sapiens
  misc_feature 8, 14: n = A,T,C or G
ctgtgttntgaaantatagacattctcactaagcccagttcatcaccatttcctcctttacctttcagtgcagtttcttttcacacttaggctgttggttcaaacttttgggaagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgtaaaataggaaaaagtgggagttgggtgaatccggttgttctttcctcacatttggatgattgtcataaggtttttagcatgttcctccttttcttcaccctccccttttttcttctattaatcaagagaaacttcaaagttaatg

SEQ ID NO: 39196 - DNA, 185 bp, Homo sapiens
  misc_feature 4, 16, 17, 63: n = A,T,C or G
gaangctctagaaaannggcgcattgcgatccaaccatcggcagccgattccgtgtcttgatnacggggtgggagggaaccgtggcgtccttgcgtggggcccatgggtgagacactccagtactgagacctagagtccagatgcttgtaggagccaagtcgtgttctaagtatttatttaaaac

SEQ ID NO: 39197 - DNA, 271 bp, Homo sapiens
cgcagtggttcacgcctgtaatcccagcactttgggaggccgaggcaggtgatcacctgaggtcaggagttcaagaccagcctgacaaacatggagaatccccaactctactaaaaatataaaattaaccgggtgtggtggtgcatgcctataatcccagctactcgggaggctgaggcaggagaatcacttgaacccaggaggcagaggttgcagcaagcaaagatcgcaccattgcactccagcccaggcgacagcccaagactccgtc

SEQ ID NO: 39198 - DNA, 132 bp, Homo sapiens
accctttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 39199 - DNA, 458 bp, Homo sapiens; identical to SEQ ID NO: 39079

SEQ ID NO: 39200 - DNA, 411 bp, Homo sapiens
  misc_feature 10: n = A,T,C or G
cggccctctnttggcccgggtctggaacctgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttactttggttgtgagatttgtctgttgcttcacacatgaagagtgggagacgttacctaacagaatgttctcttgggttgtcgagaaataattcaggtgaggccaggcacggtggctcatgcctgtaatcccagcagttttggagaccgaggcaggtggatcatttgaggtcaggagtttaagaccagcct

SEQ ID NO: 39201 - DNA, 285 bp, Homo sapiens
cgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatggtaggcctaaaagcagccaccaattaagaaagcgttcaagctcaacacccactacctaaaaaatcccaaacatataactgaactcctcacacccaattggaccg

SEQ ID NO: 39202 - DNA, 415 bp, Homo sapiens
  misc_feature 415: n = A,T,C or G
tctggaactgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttacttggttgtgagatttgtctgttgcttcacacatgaagagtggagacgttacctaacagaatgttctcttgggttgtcgagaaataattcaggtgaggccaggcacggtggctcatgcctgtaatcccagcagttttggagaccgaggcaggtggatcatttgaggtcaggagttttaagaccagcctggccaacaggggaatcccggtctgtn

SEQ ID NO: 39203 - DNA, 471 bp, Homo sapiens
  misc_feature 376, 415: n = A,T,C or G
aggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgnaaggtgacttaaacagcttaaagtttagttaaaagttgnaggtgattaaaataatttggaaggcgatcttttaaaaagagattaaaccgaaggtg

SEQ ID NO: 39204 - DNA, 199 bp, Homo sapiens
agtaaagactggttaatgataacaatgcatcgtaaaaccttcgaaggaaaggagaatgttttgtggaccactttggttttctttttttgcgtgtggcagttttaagttattagtttttaaaatcagtactttttaatggaaacaacttgaccaaaaatttgtcacagaattttgagacccattaaaaaagttaaatgag

SEQ ID NO: 39205 - DNA, 143 bp, Homo sapiens
caggtgtggtggtgggtgcctgtagtcccagctacttgggaggctgaggcaggagaatctcgaacccaggaggcggaggttacagtcagctgagaccgcaccattgcactccagcctgggtgacagagcaagattccgtccct

SEQ ID NO: 39206 - DNA, 416 bp, Homo sapiens; identical to SEQ ID NO: 27407

SEQ ID NO: 39207 - DNA, 451 bp, Homo sapiens
  misc_feature 1, 11, 438: n = A,T,C or G
natagcaaggnactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcncacccaattggac

SEQ ID NO: 39208 - DNA, 474 bp, Homo sapiens
  misc_feature 6: n = A,T,C or G
agcacncaggaggaggcagagcacagcatcttcgggaccagtactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccac

SEQ ID NO: 39209 - DNA, 469 bp, Homo sapiens
tagccgatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaaca

SEQ ID NO: 39210 - DNA, 449 bp, Homo sapiens
cagggtcttggctgcctgtgggcttccccaggtggcctggaggtgggcaaagggaagtaacagacacacgatgttgtcaaggatggttttgggactagaggctcagtggtgggagagatccctgcagaacccaccaaccggaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtaga

SEQ ID NO: 39211 - DNA, 500 bp, Homo sapiens
  misc_feature 18, 75: n = A,T,C or G
cacccagggaacttcggntcttacggccgggggtaggagcctctctccctactgctgctacacaagaccctgagnactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatcgggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctt

SEQ ID NO: 39212 - DNA, 469 bp, Homo sapiens
  misc_feature 20: n = A,T,C or G
tgatagctggttgtccaagnatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcg

SEQ ID NO: 39213 - DNA, 147 bp, Homo sapiens
ctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggcca

SEQ ID NO: 39214 - DNA, 367 bp, Homo sapiens
  misc_feature 13, 32, 146: n = A,T,C or G
gtagggcctgagnattctgcatttctgacaantctcccaagcgatagcagtgcttctattcagtggaccacatgttggatagcagggttctgtaatatccatcataacattagaggtaaaggtttttaatcctagctgtttatcangaattgccttagagcctttaaaatatgtaggtgccaggccctgctttctacttactgaattggatccccagatgtagaaaacctcagcatctatatatttgaaaaccactacagggggctggatcacacgtgtaaacctagccctttgggaggccaaggcatgtggatcacttaaactaggagttcaagaccagcttgggcaacatagtgagaccctgtct

SEQ ID NO: 39215 - DNA, 396 bp, Homo sapiens
gcataaagccaaatttccgtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacatc

SEQ ID NO: 39216 - DNA, 200 bp, Homo sapiens
  misc_feature 6, 32: n = A,T,C or G
agtaanagactggttaatgataacaatgcatngtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 39217 - DNA, 468 bp, Homo sapiens
  misc_feature 379: n = A,T,C or G
aggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcangaactgtgtgtgtcctacacaatggtgctattctgtgtcaaacacctctgtattttttaaaacatcaattgatattaaaaatgaaaaga

SEQ ID NO: 39218 - DNA, 273 bp, Homo sapiens
cgcagtggctcacgcctggaatcccagcactttgggaggccaaggcgggcgaatcgcaaggttaggagtttgagaccagcctggccaatatgttgaaaccccgtctctactaaaaatacaaaaattagccaggcatgatggcaggcgcctgtagtcccagctgctcaggaggctgaggcaggagaattgcttgaacccgggaggtggaggttgcagtgagccaagatcacgccactgcactccagcctgggtgacagagtaagactccatctc

SEQ ID NO: 39219 - DNA, 400 bp, Homo sapiens
  misc_feature 13: n = A,T,C or G
caggacccaaggnaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaaga

SEQ ID NO: 39220 - DNA, 468 bp, Homo sapiens
  misc_feature 208, 211: n = A,T,C or G
gatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctnagnagagatggagagctaaagtccaagagaggatccgagaacgctctaagcctgtccacgagctcaatagggaagcctatgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatgcata

SEQ ID NO: 39221 - DNA, 282 bp, Homo sapiens
agcacggactgtcgttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagag

SEQ ID NO: 39222 - DNA, 299 bp, Homo sapiens
gaggccttgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatacgaagacttagaagagtagcatgaggaaggaaaagataaaaggtttctaaaacatgacggaggttgagatgaagcttcttcatggagtaaaaaatgtgt

SEQ ID NO: 39223 - DNA, 342 bp, Homo sapiens
tttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 39224 - DNA, 158 bp, Homo sapiens; identical to SEQ ID NO: 30320

SEQ ID NO: 39225 - DNA, 139 bp, Homo sapiens
cgtcgtggtgggtgccagtagtcccagctactcgggaggctgaggcaggaggatggtgtgaacccgggaggcggagcttacagtgagccgagatcgcgccagtgcactccagcctgggcgacagagcgagactctgtct

SEQ ID NO: 39226 - DNA, 277 bp, Homo sapiens
agacgaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagataga

SEQ ID NO: 39227 - DNA, 162 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgt

SEQ ID NO: 39228 - DNA, 469 bp, Homo sapiens
  misc_feature 208: n = A,T,C or G
aggttttcaacctagtacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagnttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggaga

SEQ ID NO: 39229 - DNA, 325 bp, Homo sapiens
  misc_feature 4: n = A,T,C or G
gacncgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttt

SEQ ID NO: 39230 - DNA, 445 bp, Homo sapiens
  misc_feature 286: n = A,T,C or G
cacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgncttcctgtaagaccttcgggtcaaggcagagacaggaaactaactggtgtgagtcaaatgccccctgagtgactgcccccagcccaggccagaagacctcccttcaggtgccgggcgcaggaactgtgtgtgtcctacacaatggtgctattctgtgtc

SEQ ID NO: 39231 - DNA, 377 bp, Homo sapiens
  misc_feature 38: n = A,T,C or G
agggctgcagaacaaataagcacatccttgctaatttnaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacacctggacttaagacaaatgggactgatgtcatcttgagctcttcatttattttgactgtgatttatttggagtggaggcattgtttttaagaaaaacatgtcatgtaggttgtctaaaaataaaatgcatttaaacgc

SEQ ID NO: 39232 - DNA, 284 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatg

SEQ ID NO: 39233 - DNA, 362 bp, Homo sapiens
gcttttcgatccgcctctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtg

SEQ ID NO: 39234 - DNA, 361 bp, Homo sapiens
gcttttcgatccgcctctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggt

SEQ ID NO: 39235 - DNA, 369 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgggatgaagcttcttcatggagtaaaaaatgtatttaaaagaaaattgagagaaaggactacagagccccgaattaataccaatagaagggcaatgcttttaga

SEQ ID NO: 39236 - DNA, 379 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaa

SEQ ID NO: 39237 - DNA, 431 bp, Homo sapiens
gtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 39238 - DNA, 442 bp, Homo sapiens
gagaagcaggaggttttcaacctagtcacagtagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctaga

SEQ ID NO: 39239 - DNA, 468 bp, Homo sapiens; identical to SEQ ID NO: 39100

SEQ ID NO: 39240 - DNA, 411 bp, Homo sapiens
  misc_feature 6, 51: n = A,T,C or G
cacccngggaaattcggccttatggccggaccctcgagttgaaccctcggntacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattg

SEQ ID NO: 39241 - DNA, 301 bp, Homo sapiens
caacatggtgaaaccctgtttcctcaaaaaacacaaaaagtagccaggcgtggtggcgcccacctgtagtcccagctactcaggaggctgaagcagaggatcacctgaaccttgggggtcgaggctacagctagctgtgattgtaccactgcactcttgcctgagtgacagagtgagacaccaatctcaaaaacaacaaaaaatgcatattaaaaacatgtgagatgtttttacacatttcttatcacagagaaccccgtaaatatcgtatctgttatcttctggtaatttaatgttttct

SEQ ID NO: 39242 - DNA, 399 bp, Homo sapiens
  misc_feature 6, 19: n = A,T,C or G
gttggnggatgaccttganccctcaggtatcgagtatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcaga

SEQ ID NO: 39243 - DNA, 324 bp, Homo sapiens
  misc_feature 4: n = A,T,C or G
gacnacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcggatgtaaatagagcaacctatataaacctggatttttttttttt

SEQ ID NO: 39244 - DNA, 475 bp, Homo sapiens
  misc_feature 11: n = A,T,C or G
aagagcaaggnagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatc

SEQ ID NO: 39245 - DNA, 199 bp, Homo sapiens
gtaaacaataattcttaaataatatgtgttgccatgttctattagcaaatattttaagactttttaaagatcagctcttctttttgagctgagaagtctgttatttcctaattagctgggagctgggattggtcacctcactgagagaccagatataaccacacacacacacacacacacacacacacacacacacaca

SEQ ID NO: 39246 - DNA, 343 bp, Homo sapiens
ataacccagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 39247 - DNA, 289 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagca

SEQ ID NO: 39248 - DNA, 214 bp, Homo sapiens
  misc_feature 2, 7, 26: n = A,T,C or G
tnaggangatcgagaccctcctggtnacacggtgaaaccccgtctctactaaaaatacaaaaaattatgccaggtgcggtggggggcgcctgtagtcccagctacttgggaggctgaggcaggagaatggcgtgaacctgggaggtggagtttgcagtgagccaagattgtgccactacaccccagcctgggcgatagagcgagactctgtctt

SEQ ID NO: 39249 - DNA, 164 bp, Homo sapiens
  misc_feature 164: n = A,T,C or G
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgacn

SEQ ID NO: 39250 - DNA, 355 bp, Homo sapiens
  misc_feature 63, 128: n = A,T,C or G
cagaaactggccttcctctctctcagcacaccaagctgcagatccaggcttttctgggaaagngaggccaccatggctctggagaagtctcttgtccggctccttctgcttgtcctgatactgctggngctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaaga

SEQ ID NO: 39251 - DNA, 403 bp, Homo sapiens
  misc_feature 10: n = A,T,C or G
agcagcaggnaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactg

SEQ ID NO: 39252 - DNA, 210 bp, Homo sapiens
  misc_feature 182: n = A,T,C or G
agcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggngaatcggttgttctttcctcacatttgg

SEQ ID NO: 39253 - DNA, 403 bp, Homo sapiens
  misc_feature 257, 260, 395, 403: n = A,T,C or G
acagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtattttnctncatggaaattaagatagtgcatcttctgaggtcaattaaaaggagaaaaaatacaatttctcactttgcatttagtcaaaagaaaaaatgctttatagcaaaatgaaagagaacatgaaatgcttcttttctcanttttattn

SEQ ID NO: 39254 - DNA, 475 bp, Homo sapiens
cattgagcaacgggccatgatgacaatggcggttttgtggaatagaaaggggggaaaggtggggaaaagattgagaaatcggatggttgccgtgtctctgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttccctccactattgtcctatgaccgtgccaaatccccctctgcgagaaacacccaagaataatca

SEQ ID NO: 39255 - DNA, 466 bp, Homo sapiens; identical to SEQ ID NO: 38867

SEQ ID NO: 39256 - DNA, 481 bp, Homo sapiens
ctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattc

SEQ ID NO: 39257 - DNA, 427 bp, Homo sapiens
  misc_feature 17: n = A,T,C or G
gaaaggaaaaagaaatngattgttgctgtgtctgtgtagaaagaagtagacgtgggagactccattttgttctgtactaagaaaaattcttctgccttgggatgctgttaatctatggccttacccccaaccccttgctctctgaaacgtgctgtgtccactcagggttaagtggattaagggcggtgcaagatgtgctttgttaaacagatgcttgaaggcagcatgctccttgagagtcatcaccactccctaatctcaaatacccagggacacaaaaactgcggaaggccgcagggtcctctgcctaggaaaaccagagacccttgttcacatgtttatctgctgaccttccctccgctattgtcctatgaccctgccaaatccccctctccgagaaacacccaagaatgatcaataaatacta

SEQ ID NO: 39258 - DNA, 412 bp, Homo sapiens
  misc_feature 4: n = A,T,C or G
atcnagggctccaatgacgtggagatccgggcagagggcaatagcaggttcacgtacactgccctgaaggatggctgcacgaaacataccggtaagtggggcaagactgttatcgagtaccggtctcagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgc

SEQ ID NO: 39259 - DNA, 449 bp, Homo sapiens
  misc_feature 23, 328, 338: n = A,T,C or G
tgaggctgtaactgagagaagantctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaaagttgtaaaataggaaaaagtgggaggttggngaaatccggntggttctttcctcacatttggatgattgtcataaggtttttagcatgttcctccttttcttcaccctccccttttttcttctattaatcaagagaaacttcaaagttaatg

SEQ ID NO: 39260 - DNA, 147 bp, Homo sapiens
caagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 39261 - DNA, 472 bp, Homo sapiens
acccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtggtgtgtcctacacaatggtgctattctgtgtcaaacacctctgtattttttaaaacat

SEQ ID NO: 39262 - DNA, 469 bp, Homo sapiens
taggagcctctctccctactgctgctacacaagaccctgagactgacctgcaggacgtaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagaggggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttata

SEQ ID NO: 39263 - DNA, 459 bp, Homo sapiens
  misc_feature 449: n = A,T,C or G
taacaggagaaatgcaaataccttctatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtattggaaagtgcactgcagtgagggtcaaaggagagtcaacatatggggaattgttccataataaacttctgggggngatacttttc

SEQ ID NO: 39264 - DNA, 318 bp, Homo sapiens
gaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtcctcctgcct

SEQ ID NO: 39265 - DNA, 294 bp, Homo sapiens
  misc_feature 294: n = A,T,C or G
agagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcn

SEQ ID NO: 39266 - DNA, 285 bp, Homo sapiens
  misc_feature 170, 199, 279: n = A,T,C or G
gcttttggctctctgaccgcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtnaccaggacccaaggaaccaaaattgcatntgatggtctcaagggtcgtgtgtttgaagtgagtcttgctgatttgcagaatgatgaagttgcatttacaaaattcaagntgatta

SEQ ID NO: 39267 - DNA, 157 bp, Homo sapiens; identical to SEQ ID NO: 27889

SEQ ID NO: 39268 - DNA, 199 bp, Homo sapiens
  misc_feature 137: n = A,T,C or G
gacaccccgggagctgagtgattgcagaaactggccttccatctctctcagacaccaagctgcagatccaggcttttctgggaaagtgaggccaccatggctctggagaagtctcttgtccggctcctcctgcttgncctgatactgctggtgctgggctgggtccagccttccctgggcaaggaatcccgggccaaga

SEQ ID NO: 39269 - DNA, 411 bp, Homo sapiens
cgggcgtcgcggccgcccccgggggcttttcgatccgccatctgcggtgggtgtctgcacttcggctgctctcgggttagcaccctgtggtgccttctcttgtgatccctgacctaacctgtctcttccttttcctcaacctcaggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtgggtggtgctaagaaaaggaagaaaga

SEQ ID NO: 39270 - DNA, 251 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaaacgcctctt

SEQ ID NO: 39271 - DNA, 467 bp, Homo sapiens
  misc_feature 456: n = A,T,C or G
aaaatggaaagattaattgggagtggtaggatgaaacaatttggagaagatagaagtttgaagtggaaaactggaagacagaagtacgggaaggcgaagaaaagaatagggaagatagggaaattagaagataaaaacatacttttagaagaaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaatccaaaaattggataaaatagcactgaaaaaatgaggaaattattggtaaccaatttattttaaaagcccatcaatttaatttctggtggtncagaagtccgg

SEQ ID NO: 39272 - DNA, 169 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcaaaaag

SEQ ID NO: 39273 - DNA, 191 bp, Homo sapiens
acacataaatatatgattgtgaaaaggtccacaaataaagccggaaatacagctctcaagattcatagtggacttcaggatcaagatagaagagggatctcatgctaaaaccttcccattctgctcttacacatagaaatgacattttaaatggtgtgtgtgtgtgtgtctgtgtgtgtgtgtgtgtgtgt

SEQ ID NO: 39274 - DNA, 473 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaaggtg

SEQ ID NO: 39275 - DNA, 150 bp, Homo sapiens
atttgagataaagtcaatgccaaacactagctctgtattaatccccatcattactggtaaagcctcatttgaatgtgtgaattcaatacaggctatgtaaaatttttactaatgtcattattttgaaaaaataaatttaaaaatacattc

SEQ ID NO: 39276 - DNA, 471 bp, Homo sapiens
atagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagggagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaaga

SEQ ID NO: 39277 - DNA, 349 bp, Homo sapiens
gttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactg

SEQ ID NO: 39278 - DNA, 450 bp, Homo sapiens
gaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaattcggagaagatagaagtttgaagtggaaaactggaagacagaagtacgggaaggcgaagaaaagaatagagaagatagggaaattagaagataaaaacatacttttagaagaaaaaagataaatttaaa

SEQ ID NO: 39279 - DNA, 110 bp, Homo sapiens
cgcagtggctcacgcctataatcccagcactttgagaggctgaggtgggcagatcacgaggtcaggagatcgagaccatcctgactagcacggtgaaaccccgtctctac

SEQ ID NO: 39280 - DNA, 472 bp, Homo sapiens; identical to SEQ ID NO: 39160

SEQ ID NO: 39281 - DNA, 387 bp, Homo sapiens
atacaggcgtgagccactgcacctggcctaaaatttgtatttttagttgacaataattgtatatctgagaattttaattgacacaactcagtgacctactataagtagttggtgaaagaaaaggacttacatatttctggatggagcaactatgtaaatgatggcagctctcatgagatagataatattggaatagaaaaacatttgagtaatataacgtgtcatttatttcaaatatattaagtttgaagtgtgtagtatgcaatttaatagtgaatctgaaactcaaaaattgtttacagttggtgttaaaaattcaaagttgtcagaatacggttgatggtggaaattgctggagtcagttggttcactgggggatataaagac

SEQ ID NO: 39282 - DNA, 405 bp, Homo sapiens
  misc_feature 27, 405: n = A,T,C or G
aggataaggaaggaattcctcctgatngcagagactgatctttgctggcaagcaactggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgan

SEQ ID NO: 39283 - DNA, 116 bp, Homo sapiens
gctaacctagccccaaacccctccaccttactaccagacaaccttagccaaaccatttacccaaataaagtataggcgatagaaattgaaacctggcgcaatagatatagtaccgc

SEQ ID NO: 39284 - DNA, 159 bp, Homo sapiens
  misc_feature 4: n = A,T,C or G
cgantcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgc

SEQ ID NO: 39285 - DNA, 243 bp, Homo sapiens
  misc_feature 66, 148: n = A,T,C or G
cttttggctctctgaccgcaccatggcggttggcaagaacaagcgccttacgaaaggcggcaatanagggagccaagaagaaagtggttgatccattttctaagaaagattggtatgatgtgaaagcacctgctatgttcaatataanaaatattggaaagacgctcgtcaccaggacccaaggaaccaaaattgcatctgatggtctcaagggtcgtgtgtttgaagtgagtcttgctgatt

SEQ ID NO: 39286 - DNA, 387 bp, Homo sapiens
gcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccca

SEQ ID NO: 39287 - DNA, 317 bp, Homo sapiens
  misc_feature 12, 13, 53, 141, 170, 311: n = A,T,C or G
caacgctttttnntctgtcccgctgcgtgttttcctcttgatcgggaactccngcttctccttgcctcgaaatggaccccaacttgctcctgctcgcctgttggctcctgtgcctgtgccggctcctgcaaatgcaaagantgcaaatgcaccctcctgcaagaaagaanctgctgctcctgcttgccctgtgggctgtgccaagtgtgcccagggctgcatctgcaaagggacgtcagacaagtgcagctgctgtgcctgatgccaggacagctgtgctctcagaatgtaaatagagcaacctatataancctgga

SEQ ID NO: 39288 - DNA, 419 bp, Homo sapiens
  misc_feature 409: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttnaaagttggga

SEQ ID NO: 39289 - DNA, 422 bp, Homo sapiens
  misc_feature 298, 380, 397: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtntttaaaagaaaattgagagaaaggactacagagccccgaattataccaatagaagggcaatgctttagattaaatggaaggngacttaacagcttaagnttagttaaaagttgggggggggatt

SEQ ID NO: 39290 - DNA, 333 bp, Homo sapiens
cggtgacgacctacgcgcacgataacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttcga

SEQ ID NO: 39291 - DNA, 419 bp, Homo sapiens
agatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatcccagatggcattggttgctctattggactccggaggattgggggtgaccccatatatga

SEQ ID NO: 39292 - DNA, 424 bp, Homo sapiens
  misc_feature 420: n = A,T,C or G
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttaaaagttggaggngatt

SEQ ID NO: 39293 - DNA, 472 bp, Homo sapiens
agctatggagatgacaatctggctcccaacactgccaacgtccagatgaccttcctacgcctgctgtccacggaaggctcccagaacatcacctaccactgcaagaacagcattgcctatctggacgaagcagctggcaaccccaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgca

SEQ ID NO: 39294 - DNA, 440 bp, Homo sapiens
  misc_feature 17: n = A,T,C or G
gacaaccttagccaacntttacccaaataaagcataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagc

SEQ ID NO: 39295 - DNA, 234 bp, Homo sapiens
attggtgctgtaacatacgcactgtttattgattagttgtgactggtgagaaaattgtagagtctctaaaaaacttaactttaggagcataagtgcattcaaaactaaatccctattgactagcacagcgttaaaaaaaaatagtcgtggcactttgggaggctgaggcaggcagatcatttgaggtcaggagttcaagaccagactggccaacatggtgaaaccatctctact

SEQ ID NO: 39296 - DNA, 414 bp, Homo sapiens
ttccctagaaatagagagcccatgttgtgtatcagtgggaatggaaggggaggtcctgtggtagcttgagggtcaggaagccaggccaagaaagccacaaagattggattccaagtagaaggggaagaccaggcgcagtggctcatgcctgtaatcccagcactttgagaggccgaggtgggaggatcaccttgaggtcaggagtttgagaccagcttgggcaacatggagaaacctcgtctctactaaaaatataaaaattaactgggtgaggcagcaggcacctgtaatcccagctacttgggagactaaggtacaagaattgcttgaacccaggaggaagggaggttacagtgaactgagatcatgccactgcactccagcctgggtgacagagcgagactccaactcaag

SEQ ID NO: 39297 - DNA, 466 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtagaggcgacaaacctaccgagcctggtgatagctggttgtccaagatagaatcttagttcaactttaaatttgcccacagaaccctctaaatccccttgtaaatttaactgttagtccaaagaggagcagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 39298 - DNA, 159 bp, Homo sapiens; identical to SEQ ID NO: 33653

SEQ ID NO: 39299 - DNA, 198 bp, Homo sapiens
  misc_feature 37: n = A,T,C or G
agagcgaaagcatttgccaagaatgttttcattaatnagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggaagtatggttgcaaagctg

SEQ ID NO: 39300 - DNA, 420 bp, Homo sapiens
  misc_feature 335: n = A,T,C or G
agagatggagagctaaagtccagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctcttttttttctggaggctggcacctgattttgtatccccctgtagcagcattactgaaatacataggcttatatacaatgcttctttcctgtatattctcttgtctggctgcacccctttttcccgcccccagattgataagnatggaaagtgcactgcagtgagggtcaaagggagagtcaacatatgtggaattgttccataataaacttctgggggtgatacttt

SEQ ID NO: 39301 - DNA, 227 bp, Homo sapiens
  misc_feature 23: n = A,T,C or G
atttgaggtaggagttttagacngcctggccaacatgatgaaaccccatctctactaaaaatactgaaaacaaacaaaaacaattagccatgcgtggtgacggacacctgtaatcccagctacaggggagactgaggcaggagaattaaacgtgggaggtagaggttgcagtgggccaagatcacgccactgcaccccatcctgggcaacagcgcgagactccgtct

SEQ ID NO: 39302 - DNA, 416 bp, Homo sapiens
  misc_feature 409: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttnaaagttg

SEQ ID NO: 39303 - DNA, 158 bp, Homo sapiens; identical to SEQ ID NO: 30320

SEQ ID NO: 39304 - DNA, 410 bp, Homo sapiens
taggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctgga

SEQ ID NO: 39305 - DNA, 164 bp, Homo sapiens
  misc_feature 4, 8, 17, 73, 89, 118: n = A,T,C or G
cggngacnacccattcnaacgtctgccctatcaactttcgatggtagtcgccgtgcctaccatggtgaccacnggtgacggggaatcanggttcgattccggagagggagcctgaganacggctaccacatccagggaaggcagcaggcgcgcaaattacccac

SEQ ID NO: 39306 - DNA, 440 bp, Homo sapiens
  misc_feature 308: n = A,T,C or G
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctnggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 39307 - DNA, 140 bp, Homo sapiens
attcgaacgtctgccctatcaactttcgatggtagtcgccgtgcctaccatggtgaccacgggtgacggggaatcagggttcgattccggagagggagcctgagaaacggctaccacatccaaggaaggcagcaggcgcg

SEQ ID NO: 39308 - DNA, 449 bp, Homo sapiens
  misc_feature 392: n = A,T,C or G
catttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcangggctctagggactgccaggctgtttcagccaggaaggccaaaatcaagagtgagat

SEQ ID NO: 39309 - DNA, 365 bp, Homo sapiens
gtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 39310 - DNA, 323 bp, Homo sapiens; identical to SEQ ID NO: 29354
  misc_feature 4: n = A,T,C or G

SEQ ID NO: 39311 - DNA, 468 bp, Homo sapiens
taggagcctctctccctactgctgctacacaagaccctgagactgacctgcaggacgaaaccatgaagagcctgatccttcttgccatcctggccgccctagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttat

SEQ ID NO: 39312 - DNA, 323 bp, Homo sapiens; identical to SEQ ID NO: 38890

SEQ ID NO: 39313 - DNA, 363 bp, Homo sapiens
  misc_feature 7: n = A,T,C or G
acattancggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactaga

SEQ ID NO: 39314 - DNA, 157 bp, Homo sapiens; identical to SEQ ID NO: 27889

SEQ ID NO: 39315 - DNA, 112 bp, Homo sapiens
cgcagtggctcacgcctgtaatcccagcattttgggaggccgaggcaggtggatcacctgaggtcaggagtttgagaccagcctggccaacatggtgaaaccccgtctctat

SEQ ID NO: 39316 - DNA, 418 bp, Homo sapiens
gaggcattgaggcagccagcgcaggggcttctgctgagggggcaggcggagtttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgta

SEQ ID NO: 39317 - DNA, 218 bp, Homo sapiens
taggaattcgagtaccgcctgaccaacatggtgaaactctgtctctactaaaaaatataaaaaaaattagctggggatggtggcaggttcctgaaatcccagctacttgggaggctgaggcaggagaatcacttaaacccaggaggcggaggttgcagtgagctgagatcgcaccattgcactccagcctgggcaacaaagcaagactccatccaaaa

SEQ ID NO: 39318 - DNA, 390 bp, Homo sapiens
  misc_feature 30: n = A,T,C or G
aagggtttcagtatgttggccaggctggtntcaagctcctgacctcaggacatccacccaactcggcctcccaaagtactggtattaagggcatgagccaccgtgctgtgcctaaatgtggctagttcttagccttaacaaagcatctgacaggtcaggacctgatttctgcctcaattttagagacttgttctaaaggaaaaaaacacacatttgagtttttaatacatgtcagatactcaccttggaatgcaaaaacaaaatccatctagcctactcaactaaaaatgagtaagaaggccaggcgcggtggctcatgcctgtaatcccagcagtttgggaggccgaggcgggcggatcacctgaggtcgggagctcgagaccagcctg

SEQ ID NO: 39319 - DNA, 307 bp, Homo sapiens
caccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 39320 - DNA, 140 bp, Homo sapiens
  misc_feature 7: n = A,T,C or G
agaaganaaagataaatttaaacctgaaaagttggaagcagaagaaaaaagacaagctaggaaacaaaaagctaagggcaaaatgtacaaacttagaagaaaattggaagatagaaacaagatagaaaatgaaaatattg

SEQ ID NO: 39321 - DNA, 470 bp, Homo sapiens
agcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcattta

SEQ ID NO: 39322 - DNA, 434 bp, Homo sapiens
gtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagcagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagc

SEQ ID NO: 39323 - DNA, 162 bp, Homo sapiens
aggatggtctcgatctcctgacctcatgatccgcccgcctcggcctcccaaagtgctgggattacaggcgtgagccaccatgcccggccttaataactttttaaaggatgtcaagttaatggaatgtattctgctttagaaaataaaactcttaggtttcca

SEQ ID NO: 39324 - DNA, 183 bp, Homo sapiens
atagtgagaccttgtctttacaaaaaatttacaaattagccagcatggtggcacgcccctgtagtccttgctcaggaggctgaggcaggaggatcacttgagcccaggagttggtggctgtagtgagctatgatcacaccaccacactccagcctgaatgacagattaagaccttgtcacttt

SEQ ID NO: 39325 - DNA, 401 bp, Homo sapiens
  misc_feature 67: n = A,T,C or G
tgcagtggctcacacctgtaatcccagcactttgggaggttgaggcgggtggatcacttgaggtcangagttcaagaccagcctcgccaacatggtgaaaccccatttctatcgaaagtacaaaaaatgacaggcgcggtggctcacacctgtaatcccagcactttgggaggccgaggcggatggatcacgaggtcaggagatacagaccatcctggctaacacagtgaaaccccgtctctactaaaaatacaaaaaatcagccaggcgtggtggcgggcacctgtagtcccagctacttgggaggctgaggcaagagaatggcatgaacccaggaggtggagcttgcagtgagccgagatcgtgccactgcactccagcctgggcgacagagtgagaat

SEQ ID NO: 39326 - DNA, 178 bp, Homo sapiens
ttcccagcacttacattaatcagttatgtggctgggcacggtggttcacccctgtaaccccaacactttgggaggccaaggcggaggatcgcctgagcccagaaggtcggggatgcagcgaaccatgatcacaccactgcacttcagcctgagtgacagagtgagaccctgtctctac

SEQ ID NO: 39327 - DNA, 285 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttctcatgga

SEQ ID NO: 39328 - DNA, 469 bp, Homo sapiens
  misc_feature 22: n = A,T,C or G
agtctgtcgatcccaggccganacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatga

SEQ ID NO: 39329 - DNA, 106 bp, Homo sapiens; identical to SEQ ID NO: 27192

SEQ ID NO: 39330 - DNA, 329 bp, Homo sapiens
agactttgcaaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 39331 - DNA, 195 bp, Homo sapiens
  misc_feature 14, 32, 52: n = A,T,C or G
agcctcacttttantgaaacaaatggcctttnttaaaaactgagtgactctntactagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 39332 - DNA, 433 bp, Homo sapiens
  misc_feature 9, 101: n = A,T,C or G
cctcccccnctgatactgtttttactaggtgcaactgtgaaggaaaaactttcttctttaaggattctcagtactggcgttttaccaatgctataaaagangcagggtaccccaaaccaattttcaaaggatttggaggaccaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaaacgacacaggttagggagacgtcgctttggaacgtgctataggaccttctcaaacacacaccatcagaattcaatattcacctgccagactggcttatcaagacaaaggtgtccttcataa

SEQ ID NO: 39333 - DNA, 471 bp, Homo sapiens
ctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgaattttttgggcctatttgaagatacctgctcagtatgacgcttctgagctaaaagcttccatgaaggggctgggaaccgacgaggactctctcattgagatcatctgctccagaaccaacca

SEQ ID NO: 39334 - DNA, 322 bp, Homo sapiens
  misc_feature 56: n = A,T,C or G
acagacatttgtggaaaacagtttgtagagcttcctcaataaaaacacatatgatnccagcaatcccactactgggtattatatccaaaaggaaaatgaaatcagtatgttgaagaagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgatgaaaccccgtctctacaaaagat

SEQ ID NO: 39335 - DNA, 359 bp, Homo sapiens
  misc_feature 3: n = A,T,C or G
gtncaaccctccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaat

SEQ ID NO: 39336 - DNA, 465 bp, Homo sapiens
gacccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtgggccgagtgtaacaaccatataataaatcacctcttccgctgttttagctgaagaat

SEQ ID NO: 39337 - DNA, 441 bp, Homo sapiens
  misc_feature 183, 316, 336, 407, 434: n = A,T,C or G
gtttggagaaacctaaatggtggcttccatttaagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaangccctgctcatccagggctccaatgacgtggagatccgggcagagggcaatagcgggttcacgtacactgccctgaaggatggctgcacgaaacataccggtaagtggggcaagactgttatcgagtaccggncacagaagacctcacgcctncccatcattgacattgcacccatggacataggagggcccgagcaggaattcggtgtggacatagggccggnctgcttcttgtaaaaacctgaacccanaaacaac

SEQ ID NO: 39338 - DNA, 472 bp, Homo sapiens
  misc_feature 438: n = A,T,C or G
gcaaaagataaggaaaatattaatgaaaaattgaaatggagactagccttgatccagaaggtccaccttctcaccttcaggacacatggcttaatgagcagatgatgctctttgactgggatccaggacttgatgggtgggacacaggctgaatttcagctttcactcttcagtgggatcttctagtgcatggtgcaacctgcataattatatatagcagccctgcaccttctacataataataggcctagaaagagattagaaacaaaatagaaacgaaaggaaaaaatagaggaaaatttatctgagctaaagaaaggctcagttgaagtcattagtttgaacagccttgctgattgtcaagagaagtaagtgcaaaagtatccataattagtctgcattcagatgcaggaacctggtgctagagaagctgctcangcacaggaactgggcattgaagctgtatatgctg

SEQ ID NO: 39339 - DNA, 103 bp, Homo sapiens
  misc_feature 15, 30, 39, 41, 47, 56, 67, 84: n = A,T,C or G
aggcgcgtggggctngaggccgaaaacggnccttgctgncnccaacntggagactntgtaccgtgtnccgtctcttagtgctcnaatgtcccaacctgaaact

SEQ ID NO: 39340 - DNA, 416 bp, Homo sapiens
gaggcattgaggcagccagcgcaggggtttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaagatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagttaaaagttg

SEQ ID NO: 39341 - DNA, 470 bp, Homo sapiens
catgttaatgagaatttccccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctg

SEQ ID NO: 39342 - DNA, 472 bp, Homo sapiens
gttgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttatttgtcttcctgtaagaccttcgggtcaaggcagaggcaggaaactaactggtgtgagtcaaatgccccctgagtgactgcccccagcccaggccagaagacctcccttcaggtgccgggcgcaggaactgtggtgtgtcctacacaatggtgctattctgtgtcaaacacctctgtat

SEQ ID NO: 39343 - DNA, 288 bp, Homo sapiens; identical to SEQ ID NO: 21514

SEQ ID NO: 39344 - DNA, 402 bp, Homo sapiens
tccccatctccgctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaacagctaaatataagaactggcctgaatctgtgtattttttcaagaagaggtggcagcattcagcagtatatttataaacaggaacctgtacagaagtgccctggaagaaggcctgctctaaattatccagtgtatgggagaaacgacacaggttagggagacgtcgctttgaacgtgctataggacctt

SEQ ID NO: 39345 - DNA, 350 bp, Homo sapiens
tttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaga

SEQ ID NO: 39346 - DNA, 162 bp, Homo sapiens
cgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 39347 - DNA, 148 bp, Homo sapiens
cggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgaaaaaaaag

SEQ ID NO: 39348 - DNA, 409 bp, Homo sapiens
  misc_feature 3: n = A,T,C or G
ccntttttttggaaacctctgcgccatgagtagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 39349 - DNA, 310 bp, Homo sapiens
tgtttggtgcatgcctgtagtcccagttactcctgaggccgaggcaggaagatcacttgaacccgggaagcagagaccgcaatgagccgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttatttgaaatggagtctcgctctgtcac

SEQ ID NO: 39350 - DNA, 289 bp, Homo sapiens
  misc_feature 72: n = A,T,C or G
ccgggcgcggtggctcacgcctgtggtcccagcactttgggaggccgaggtgggtggatcacttgaggtcangagttcaagaccagcctggccaacatggtgaagccccgtctctgctaaggatagcaaaaattagccgggcgtggtggcaggcgcctgtggtcacagctgctcgggaggctgaggcccgaggatcgcttgaaactgggaggtggaggttgcagtgagctgataactgcaccactgcactccagcctgggtgatagagtgagactcagtctcaaaaaac

SEQ ID NO: 39351 - DNA, 468 bp, Homo sapiens
taggagcctctctccctactgctgctacacaagaccctgagactgacctgcaggacgaaaccatgaagagcctgatccttcttgtcatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttat

SEQ ID NO: 39352 - DNA, 362 bp, Homo sapiens
  misc_feature 6: n = A,T,C or G
gtagcntgaggaaggaaaagataaaaggtttctaaaacatgacggaggttgagatgaagcttcttcatggagtaaaaaatgtatttaaaagaaaattgagagaaaggactacagagccccgaattaataccaataggagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtg

SEQ ID NO: 39353 - DNA, 147 bp, Homo sapiens
  misc_feature 18: n = A,T,C or G
gactctatatagctgatngttttttccctggaagcatttgtttctactttgatatgactgtttttcggacagtttatttgttgagagtgtgaccaaaagttacatgtttgcacctttctagttgaaaataaagtgtatattttttct

SEQ ID NO: 39354 - DNA, 273 bp, Homo sapiens
cgtggtggctcatgcctgtaatcccagcactttgggaggccgaggcaggcgaatcacgaggtcagaagatcgagaccatcctggctaacatggtgaaaccctgtctctactaaaaatacaaaaaattagctgggtgtggtggcgggcgcctgtagtcccagctactcgggaggctgaggcaggagaatggcgtgaacccgggaggcggaacttgcagtgagccgagattgcgccattgcattccagcctgggcgacagcgagactccgtcaca

SEQ ID NO: 39355 - DNA, 159 bp, Homo sapiens
cggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgataaaagaaaaaaggagaag

SEQ ID NO: 39356 - DNA, 342 bp, Homo sapiens
tttccggcggtgacgacctacgcacacgagaacatgcctctcgcaaaggatctccttcatccctctccagaagaggagaagagggaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggac

SEQ ID NO: 39357 - DNA, 114 bp, Homo sapiens
cagctactagggaagctgaggcacaagtaatcacttgagcccaggagacggaggttgcagtgagctgagattgtgccactgcactccagcctgggtgacagagtgagaccccgt

SEQ ID NO: 39358 - DNA, 272 bp, Homo sapiens
cacggtggctcatgccggtaatcctagcactttgggaggccaaggtagacagatcacgaggtcagcaattcaagaccagcctgaccaacatggtgaaaccccgtctctactaaaaacacaaaaaaattagccgggcatagtggctggcacctgtaatcccagctacccgggaggctgaggcagaagaatggcgtgaacccaggaggcggagcttgcactgagtcaagatcgcgccctcgcactccagcttgggcgacggaggaagaccctgt

SEQ ID NO: 39359 - DNA, 286 bp, Homo sapiens
aacggaaaaggagaatcgcttgaacccgggagacggaagttgtggtgagctgagattgcaccattgcactccagcctgggcaacaagagtgaaactctattaaataaataaataaataaataaataaataaataaatagaataaaaaatacaaaatttggccaggcacggtggctcatgcctttaattccagcactttgggaggccgaggtgggtggatcacctgaggtcaggagttcaagaccagcctggccaacgtggtgaaaccccatctgtactaaaattac

SEQ ID NO: 39360 - DNA, 157 bp, Homo sapiens; identical to SEQ ID NO: 27889

SEQ ID NO: 39361 - DNA, 202 bp, Homo sapiens
  misc_feature 24: n = A,T,C or G
agattgaggttcatcatcaatagnataaatgatagaacaattaaacaagaataaataaaggtgaatcattgttcaattatgaatatacatgatgatataagaaatattatcactaaaaattttaaacacagatgccccttaaagaaatggatcatgagtcccgccactgcactccagcctgggcgacagagcgagactccgt

SEQ ID NO: 39362 - DNA, 226 bp, Homo sapiens
gaaggcatctgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatga

SEQ ID NO: 39363 - DNA, 469 bp, Homo sapiens
  misc_feature 29: n = A,T,C or G
agcctggccaacatggtgaaaccccatcnctactacaaaaaatacaaaaattagctgggcgtggtgctgggcgcctgtaatcccagctgctcgcgaggctgaggcagggagaattgcttgaacccgggaggtggaggttgcagtgacccaagatcatgccactgcactccagcctgggcaacagagcgagactccatctcaaaataaataaataaacaaacaaacaaaggactgagataatcaatttgctattgaagaaagtgtggtaaaattgacactgcatatactagtatattagaatgtaaacaggtacaaattttagtaatgtgaatacgcagtcttaaagatgcccgtatctcttgcctcaataatctcacttaaaagtctatgccaaaaccgggcacagtgactcacgcctgtaatcctagcactttgggaggttgaggcaggaggctcgcttgagcccaac

SEQ ID NO: 39364 - DNA, 488 bp, Homo sapiens
  misc_feature 29, 31: n = A,T,C or G
ctcaccatttggggacgctctcagctctntncgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacag

SEQ ID NO: 39365 - DNA, 111 bp, Homo sapiens
  misc_feature 30: n = A,T,C or G
ctcatgcctgtaatcccagcactttgggangccgaggcaggcggctcacgaggtcaggagatcgagactatcctggctaacacggtaaaaccctgtctctactaaaagtgc

SEQ ID NO: 39366 - DNA, 159 bp, Homo sapiens
  misc_feature 13: n = A,T,C or G
aggaagcagaagnaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggag

SEQ ID NO: 39367 - DNA, 477 bp, Homo sapiens
  misc_feature 33: n = A,T,C or G
atgaacaatatagacattctcacataagcccanttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtccggatctcacaggctgagaactcgttcacctccaagcatttcatgaaaaagctgcttcttatt

SEQ ID NO: 39368 - DNA, 235 bp, Homo sapiens
cgaccaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 39369 - DNA, 255 bp, Homo sapiens
  misc_feature 16, 32: n = A,T,C or G
agaaaacatatatgtnatacctccattggggnataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 39370 - DNA, 364 bp, Homo sapiens
aggatgcaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagataggaaatgaaaatattgtcaagagtttcagatagaaaatgaaaaacaagctaagacaagtattggagaaatatagaagatagaaaaatataaagccaaaaattggataaaatagcactga

SEQ ID NO: 39371 - DNA, 474 bp, Homo sapiens
  misc_feature 23: n = A,T,C or G
cctaccgagcctggtgatagctngttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaa

SEQ ID NO: 39372 - DNA, 471 bp, Homo sapiens
  misc_feature 7, 28, 34: n = A,T,C or G
ggcattnaagaagcatcctctgccaagnaccaanaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctat

SEQ ID NO: 39373 - DNA, 470 bp, Homo sapiens
ctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaagtttttaaaatcagtacttttt

SEQ ID NO: 39374 - DNA, 344 bp, Homo sapiens
  misc_feature 270: n = A,T,C or G
tgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggngctattctgtgtcaaacacctctgtattttttaaaacatcaattgatattaaaaatgagaagattattggaaag

SEQ ID NO: 39375 - DNA, 203 bp, Homo sapiens
gaatcttagttcaactttaaatttgcccacagtaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaat

SEQ ID NO: 39376 - DNA, 468 bp, Homo sapiens
gaggtttgggaacctccacctggatttcacatgatgtatggaaatgcctggatgtccaagcagaagtttgctgcagtggtggcaccctcatggagaacctctgctagggcaatgtggaagggaaatatgggattcgagcctccacacagagtccacactggggctttgcctactggagctgtcagaagagggccactatcctccagaccccagaatggtagatccacaaacagcttgcaccatgcacctggaaaagctgcagacactcaacagcaagccatgaaagcatctgggaggggagctgtatcctgcaaagccacagggctggagctgcttgaaggctgtaggagcctacctcttgcatcagcatgatctggatgtgagacatggagtcaaaggaaattatttcagagcttttaagacttaattactacctcattggattttagtcttgcatggggcctggag

SEQ ID NO: 39377 - DNA, 235 bp, Homo sapiens
  misc_feature 1: n = A,T,C or G
ngggaattcggccttatggccgaggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgaga

SEQ ID NO: 39378 - DNA, 474 bp, Homo sapiens
ggcagagggagaaggggtgcaggcacgtaacatggcaagagcaggagcaagagagaagggggcaaggcaccacacttgcaaaccaccagatgtctcgagaatcactcactaatgcaaggacagcaccaagccattcatgggagatctgcccccatgagccagacacctcccaccagttcctacctccaacattggggattacatttcaacatgagatttggaggggacaaacatccaaactatatcagagactacttagacccaaaacaaactaaagccgaaggaattacatattccatatttggtctagttgttgggagggaaaaattgctgcaagaattcagatatactaaaattcaaatgaaatggcctgatctatgccagattttatgaaatgtgtttattctaaacccaagaagagtattttcctcagccttgttttttccttctatgtattatgcatagaaagcaact

SEQ ID NO: 39379 - DNA, 466 bp, Homo sapiens
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttt

SEQ ID NO: 39380 - DNA, 344 bp, Homo sapiens
atcttaaaaaatttgtaattctaatcttttatttttgatcagggaatgtatttattgattcacatgaataaaattcaaaggctatagaagaatatgtagcaaaaaaatctctcttctaatctagtagcctaattcttctcctcagaggtgatagatattaccagttctttttgttccctttcagacatattttagatatatatgaaatcctctccctcttcttattttcctcacataaatgatagcatgatgtgcatactttatatttttttgtgttttgtcttttttctacttaatgacatatcttggaggctatacatattaatatataaaagaatttctac

SEQ ID NO: 39381 - DNA, 471 bp, Homo sapiens
  misc_feature 9: n = A,T,C or G
gagcagagnaagaggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtc

SEQ ID NO: 39382 - DNA, 107 bp, Homo sapiens
  misc_feature 3: n = A,T,C or G
cgnaggaaactgtgtgtgtcctacacaatggtgctattctgtgtcaaacacctctgtattttttaaaacatcaattgatattaaaaatgaaaagattattggaaagt

SEQ ID NO: 39383 - DNA, 440 bp, Homo sapiens
  misc_feature 2, 8: n = A,T,C or G
anctcttnattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtattttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgc

SEQ ID NO: 39384 - DNA, 343 bp, Homo sapiens
catgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcgcgcttgtggtcccagcactttgggaggcccagacgaggggctcgcttggggcccggagttcaagaccagcctaggcaatgtttgcatgtctct

SEQ ID NO: 39385 - DNA, 467 bp, Homo sapiens
gctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatgtcaaggggcctgaagacaagaagaaacacctccttattggtgtgtcctcagatcgaggactgtgtggtgctattcattcctccattgctaaacagatgaaaagcgaggttgctacacctaacagcagctgggaaagaagttatgcttgttggaattggtgacaaaatcagaggcatactttataggactca

SEQ ID NO: 39386 - DNA, 216 bp, Homo sapiens
  misc_feature 4, 11, 12, 16, 17, 23, 29, 30, 35, 36, 40, 49: n = A,T,C or G
ggancactttnncctnngttctntcctannaaganngtanttttttttnttgtcccttaaaaagaagctcttagcatgaaaattaaaaggaaagggaaagaaatagatctggtgcacccgaacattaggagaaaatgaaaaatatacaaccaaccgttcgtgagtcatcaaaaagtcaaagtcggcctggccaacatggcaaaactccgtctctgc

SEQ ID NO: 39387 - DNA, 159 bp, Homo sapiens
agatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattg

SEQ ID NO: 39388 - DNA, 263 bp, Homo sapiens
atccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcaagttgtgtagtagttaaggactatggcaaggagtctcaggccaaggatgtcattgaagagtatttcaaatgcaagaaatgaagaaataaatctttggctcac

SEQ ID NO: 39389 - DNA, 351 bp, Homo sapiens
  misc_feature 7, 11, 25, 30, 31, 53, 55, 66, 317: n = A,T,C or G
cggctcnctcnggcccggggcgaantagannctgcccaaaagttctgattttnanaaatgttttanttgtgggccgggcgcagtggctcatgcctgtagtcccaggactttgggaggccgaggtgggtggatcatgaagtcaggagatcaagaccatcctggccaacacagtgaaaccccatgtctactaaaaatacaaaaattaactgggcttggtggtgcacgcctgtaatcccagctactcaggaggctgaggcaggagaatcccttgaacctgggaggcggaggttgtagtgagccgagattgtgccactgcnctccagcctggcaacagagcaagactccgtctct

SEQ ID NO: 39390 - DNA, 500 bp, Homo sapiens
  misc_feature 4, 7, 38, 45, 51, 77, 359, 477: n = A,T,C or G
agcntcntcccctgggctttgcttcctggctttgtgancgcctantaagancagaagcaggccacactgtggcccantctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgccttgggggtccctcacctggctagggagataccgaagcctactgtggacctgaagacttctgggttctttccttctgctaacccagggagggtcctaagaagnaaggtgacttctctctgtttgtcttaagttgcactgggggatttctgacttgaggcccatctctccagccagccactgccttctttgtaatattaagtgccttgacctggaatggggnaagggggacaaagggtcaagtct

SEQ ID NO: 39391 - DNA, 108 bp, Homo sapiens
  misc_feature 3, 18, 73: n = A,T,C or G
tanttcctcctgaggaanctctacctttctgagcccaaacctgctaacttttctgcggaactgtctagaagantccttcaagagacccctgcagttgcactttctcgt

SEQ ID NO: 39392 - DNA, 487 bp, Homo sapiens
ggggcttagatggaccacaaagggtgccctgtaagaagtggtctgaggagggaaccctgggaacacccatattcaggggaagaaggggagcagaaggaatctttgaagaaccgtgatgagtgactaaagacagagcagtgtccgtagcatataactgatgaataaaatcctgcttccttgataatagaaacatgttgctgctttgttccctttatatgactgaaaaagctgtgttctctttcagtgaaaaagaaaccataattgtctttctggagatttgaatttagaaggacagtgaagataggggaggatgaaatcttgcttctccctttttttgaaactagagatacctaaggaagaagaaaaggagaaatggaagaaatcaaactttgtctttcccctgctcagtctctaagccctcaaggaaaggtgttgggatagactgagtccccatgatggtgttttttgcacttcaaaagcacactta

SEQ ID NO: 39393 - DNA, 399 bp, Homo sapiens
  misc_feature 2, 8, 24, 35: n = A,T,C or G
anctgtantccctcccttctgtcnctgaggaagangtctcaaatggatcttcctccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatattgttttgcattgccatttgatttcaaattaatcaggaagaattagtgattttaatgagcagtaaagtggtgcaataaagcagaaagaaaaatgttcagccagaagtgaaagactagc

SEQ ID NO: 39394 - DNA, 312 bp, Homo sapiens
  misc_feature 2: n = A,T,C or G
anctgtaggaggaaagagtgcttcgctgcctccttaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgac

SEQ ID NO: 39395 - DNA, 221 bp, Homo sapiens
  misc_feature 18: n = A,T,C or G
gaggcattgaggcagccnagcgcaggggcttctgctgagggggcaggcggagcttgaggaaaccgcagataagtttttttctctttgaaagatagagactaatacaactacttaaaaaatatagtcaataggttactaagatattgcttagcgttaagtttttaacgtaattttaatagcttaagattttaagagaaaatatgaagacttagaagagcagc

SEQ ID NO: 39396 - DNA, 468 bp, Homo sapiens
ggaaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtcta

SEQ ID NO: 39397 - DNA, 489 bp, Homo sapiens
  misc_feature 19, 70: n = A,T,C or G
gttgttttgaccgggaganctagagagtgctcagaattagggcctggcattttggaatcacaggatttantcatcacagaaacaactgttttaagattagttccattcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttatttagaagaaaattctgattttataggaaaaaaaatagagcaaggagaatataacatgtttgcaaagtcatgtgttttctttctcaatgagggaaaaacaattttattacctg

SEQ ID NO: 39398 - DNA, 464 bp, Homo sapiens
  misc_feature 2, 18, 68: n = A,T,C or G
cnttggccgggggtggcntttttcgttggtggtgttcagttgtggcggttgctggtcagtaaccagcnaagatgctgcggaatctgctggctcttcgtcagattgggcagaggacgataagcacctgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatattttattgaccttgtagtaactgccaccaataaagcagtcttta

SEQ ID NO: 39399 - DNA, 371 bp, Homo sapiens
  misc_feature 9: n = A,T,C or G
atgtcagantttatatcaattctgaaggtaatcttcctatgcccttattatgtccctaggaaatctctattcacaaatgtttgttatgtagttggcctactaagtttctaagttacaatcatgtatcttgttttatcaaaattaaatgtctccacctgtttttaccattttacaatttacaaaatggcttcatataaccataaatctatattctcaaggggaatttggaaagaatcagagtttttatagtcacttagtttccaaaggcttaaagaaaatgaaatgccctgaacccaggaggcggagcttgcagtgagcagagatcacgccactgcactccagcctgggtgaaagagcgagactccgtccca

SEQ ID NO: 39400 - DNA, 477 bp, Homo sapiens
gggtgtttcaggggtgtcttcctttactctcttctcactgatttccagctatccctgtgtctcttgtttaatgagtgccttcacccatatccttaaacccaccagggcgaccttcctgcccctttctttggagagctgtatctgtatttccagtggagacacagactgttccttagatcctattaaccctctgagctctctctcttcaagccaggctcatttctggcttggccaatctgcctcctcccgtgtcctttccatgacacggtgatggcatcaccagccagtcaccaagctagaacaatcccttcacccggcccctactgtaggaggatacttttagaagtatgtctgcaattcacccccactctctgtatctacttctgtggccaaagtgcggaccttgatttcctctggccccagctgaattaacccacctctctgggcctggttctcttttcactaaacattctccac

SEQ ID NO: 39401 - DNA, 473 bp, Homo sapiens
  misc_feature 136, 345, 415: n = A,T,C or G
gtttttaatgacaatattctgttgaacggttgtaccatactcagccatgccctttcattttgacgatagtgtttctaatattttgtatttttattcccctccccccatttttgtattacttaagatagattatcangaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggngtttaaaaagatgtttattctgtttgtcaggtacaaagatatttatgatacatgtatgacttgtctaagntattaacattttctctagccttaaggaatgcatgaaacacatgtttcagtgccactca

SEQ ID NO: 39402 - DNA, 473 bp, Homo sapiens
gtatccaaaagaatgaattggatccctactttacacaatgtaaaaaaataaattcaaaatggattatagaacttaatgtaagggcttataaaattctaagaagaaaacatagaagtaaatcttcatgatcttggagctagataatggctccttacatttaaaacctaaaatataagcaataagaaaatagataagttggactgaattaaaattaaaaacttttgagtgtaaaagaatacattaagagaatattacagcaatccatagaatgggaaaaaattgcaaatcacatatgtgataacaggattgtatctggaatacataaagatacaagtatcttacaacttgtatctttatctacaaggatcttataactcaacaacaaaaagacaacctaaataaaatatgggcaacaattttgaatagatatttctctaatgaagatacacaaatgaccaacagcatatgaaaag

SEQ ID NO: 39403 - DNA, 377 bp, Homo sapiens
tcctatatgattttctagcccatgacattcttctttctttattctttcttttcttcattagcaaactagtcaatttttattgaaggcttactctgtgttcacctctgtactaagctctggaagtgcaaagataattagggaaatgatccttgtatacaaatgcttgcattcctgctggaataatggacacataatcaaattgtcaggcagtgtgaccactctgagcattcaaatgtttgttgaatgagtgagagggataacaataatgttaaagcaatcagagagagggagtggtagttttttgtgggatggaaaaggcttcacagaggaggtaacatttaagtaaggatcttgcaggatgataaatggaggaagtg

SEQ ID NO: 39404 - DNA, 481 bp, Homo sapiens
  misc_feature 19, 24, 41, 42, 57, 71, 81, 210: n = A,T,C or G
atagcaagttttttcctgntttcnaattaaatgcttaagannaaagcagcatcctanaaaattgtgatcanaaacatccantttccctcagcttttgtgagtgccttgacttacagccaacatcactgtttaactcagtctgtttaaaaacaaacttttctggtggttgataacagagagttgctccctgagccatcagggtcctggganctggaagtgaaagggttattaacattctacctttatgcagctgttggctgaccagaataaactccctgctgagttcaagctttgaatggaatggatgcaaatgaatggttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaaca

SEQ ID NO: 39405 - DNA, 260 bp, Homo sapiens
  misc_feature 223, 234, 247: n = A,T,C or G
cacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcactaggatatgaagcttttgttgaaagtnggaaaaaaagngaaattaaagacnttcccagacaatt

SEQ ID NO: 39406 - DNA, 234 bp, Homo sapiens
ggccaaggtgggtggatcacgaggtcaggagatcgagaccatcctggctaacacagtgaaaccccatgtctactaaaatacaaaaaattagccaagcatggtgacacacatgtagtcccagatactcgggaggctgaggcaggagaattgcttgaacccgggaggaagaagtcgtagtgagcagagatcgcggcacttgtactccagcctgggtgacagagcaagactccatct

SEQ ID NO: 39407 - DNA, 108 bp, Homo sapiens
  misc_feature 36: n = A,T,C or G
atttcatgtccatatattggaagaatcaatattgtnaacatgttcatattacctaaagcatctacagattcaatgcaatttctattaaaataccaatgacattctgcg

SEQ ID NO: 39408 - DNA, 199 bp, Homo sapiens
cgggaaaaaggcgggagaagccccggcaggtttgaagctgcttcttcgaatttgcaattcaatatgaaaatcacctcggagctggtaaaaagaggcctaacccctgtctttagaatttacagtccaatgcttcactcagccattttacctcacccccactgatgttcgccgaccgttgactattctctacaaaccacag

SEQ ID NO: 39409 - DNA, 472 bp, Homo sapiens
  misc_feature 463: n = A,T,C or G
ggagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgnctggctgca

SEQ ID NO: 39410 - DNA, 472 bp, Homo sapiens
  misc_feature 470: n = A,T,C or G
gacccgaaacatggacctgggacttaaagatggaggaagctatgagcaatacaggcagtttcagcgtcggaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcgcaaaggaaaacggagagagcgagcgagaaaaaaatttnct

SEQ ID NO: 39411 - DNA, 473 bp, Homo sapiens
  misc_feature 307, 425, 465: n = A,T,C or G
cgaagcactctatctgtattacaattactgcatgtacatgactcatctccctttacatttgttaagaatttttgaggggcttttcagaccatgttttgttctattttgaatcctctacaacattgcttttcaaagtatggtttgttggaccagccattgattggcttcaacagttttgttactggtctgggacaagatagtgagctggcatcagaatataaatcagatgtgtcactaaacacactgcttggttcagctgacttttttttatacaagaagacattggtaaagaagaaaactgtgtgtngggtttacattctggcacaagcttcttattttgtagcagattggcaccttaaggagcattacttttaatatccaagaaaaaagtagattcttagtaaattactaatgaatggagttgnaggatattttggtcctgtcaactattatataagggggagnaaatacat

SEQ ID NO: 39412 - DNA, 265 bp, Homo sapiens
  misc_feature 38: n = A,T,C or G
tatggccgggataataattacatcacaagacgtcttgnactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagacc

SEQ ID NO: 39413 - DNA, 467 bp, Homo sapiens
  misc_feature 10: n = A,T,C or G
ggctcccagnaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctc

SEQ ID NO: 39414 - DNA, 484 bp, Homo sapiens
tatggccggggtgtaaacattaaaatattaatgctagatattttcctgtgtcattaatgtcagatatatgtttaataaagcactggccctaccttgtgtgattcaaagttcagatgccctggttggtgccccaggtagcttagtgctggcttctttgtcccctgtagtctatgttcagatccagcaaccatattaaagaacttgagggattcggtctaactgaagaggaatgggggatcctgttaggtgcaggtttgccctttatattatgctagctcacacttgtagcaaaatgttctcataagcaggttgatttgtgttcagccacatagattatagtcctaaaaatgtaggaagttttttgagttcctgttgcatattcagaatagctatagaattccctgaaaggctaggcttgaatagcatttgctccaggaactgcttttaaaaagttttactttctttctttcttgcttttttggtt

SEQ ID NO: 39415 - DNA, 289 bp, Homo sapiens
  misc_feature 4: n = A,T,C or G
aganaaagtttctgctttcgtaagatttacctgataagggggtaaaatgttaaacaagttcacaggatcattttagatggcaataagagctctgaagaaaatacaatataaccatgtgataaagtgatggagggtggggaagggagatgatgaggactactttaggccaaatcggagccacagtctgaataacatagaagggtcaaccatggaagatttggaggaaataacattctaaagagaggaacttaagagttctgtattgatggttcatttctttctttccttt

SEQ ID NO: 39416 - DNA, 469 bp, Homo sapiens
gaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatatttttagtgctataaaatactatgtgaatctcttaaaaatctgacattttacagtctgtattagacatactgtttttataatgttttacttctgccttaagatttaaggttttttaaatgtattttttgccctgaattaagtgttaatttgatggaaact

SEQ ID NO: 39417 - DNA, 419 bp, Homo sapiens
gctgattcaatggtgatcttgaggacacagattgtatatttttttttaatctccagagacatgtaggcatgcaataaatggtctgccttggacttaccttacactaaaacccttgacactagaagtgggtgatttaaaaagaaacaaataaaaagtaaaaaataaataactcagagaaactctttaccttcattcatagttttcatttgactgttcaagaggaatatctaaggtcttatgatagtaaaattttcttattctttagaaagtctgactgtatctattttagaagccctatagtctatagtagtttttgataactatatgaattaatggatgaatgaatttccaaaaaattattgaaaactggatttttaaattaacatgagagaccagtaaacatttgtgtttgtttaacc

SEQ ID NO: 39418 - DNA, 466 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggtaccccaatctgaag

SEQ ID NO: 39419 - DNA, 297 bp, Homo sapiens
gcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacat

SEQ ID NO: 39420 - DNA, 488 bp, Homo sapiens
  misc_feature 436: n = A,T,C or G
ggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattnggatgaattccaaattctgcttgcttgctttttaatattgatatgcttatac

SEQ ID NO: 39421 - DNA, 435 bp, Homo sapiens
  misc_feature 417, 421: n = A,T,C or G
agggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggngggngaaaataaataaat

SEQ ID NO: 39422 - DNA, 469 bp, Homo sapiens
aggagcagagggcagagcctcagcaggaagagtgtctctttgagaaggagacacagtggagcaggtgtgtaggttcacagggccagctatgggtagagtcgggtgtacatttttagaagccacaattcccaaaaatctcctgactataacatcagtgcacagagccagtcaaatggaggaggagtgggtccaggcaattcaggaagaaggaaagtaacaaatgagtggttgcaggaggacactttttctgtcgaggtcactaaacaaaacattgtctcctccccttaacttcagaaacgatggagggtaaaaagtgtcgcctgggccctgggggcaaagacagtagataacttctctgtcgtgttctccagaagggcccaacaattacaaggttctacggttctaaattccaacctagtcttccacatcattttgaaggtataatattacttgtcaaaagtggggatga

SEQ ID NO: 39423 - DNA, 259 bp, Homo sapiens
  misc_feature 8, 9: n = A,T,C or G
gaaggaannaggcaggaatctttgctgttctgtagcctccgctggtgatacccaggcaaaaaagggtctggagtggacctccagcaaactccagcagacctgcagcagagggacctgactgttagaaggaaagctagcaaacagaaaggaatagcatcaacatcaacaaaaaagatgtccacacaaaaaccccaccgaaggtcaccaatatcaaggaccaaagatagataaatccacgaagatgaggaaaaaccagcgc

SEQ ID NO: 39424 - DNA, 330 bp, Homo sapiens
  misc_feature 6: n = A,T,C or G
aatgancagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgccttgtagtcccagctacttgggaggctgaggcaggagaatctcgaacccaggaggcggaggttacagtcagctgagaccgcaccattgcactccagcctgggtgacagagcaagattccgtcac

SEQ ID NO: 39425 - DNA, 475 bp, Homo sapiens
  misc_feature 24, 42: n = A,T,C or G
tatggccgggatgtttaccttttntttaaatttaatctcttntgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcat

SEQ ID NO: 39426 - DNA, 233 bp, Homo sapiens
  misc_feature 228: n = A,T,C or G
agccttgagggataatctggcttctactccaagataagttcagctcttacaggagacggaagctttcagggaattaatgtagctgagggaagaaaagcaaatgggagtgataccaacagtgaccaaccagaagcttatctcctgtcaaagtgacagccacagaggagctctggccattgctatggaagaccatggcccctctcccaaaaaaaaaaaatttctcagatnccttc

SEQ ID NO: 39427 - DNA, 468 bp, Homo sapiens
  misc_feature 25: n = A,T,C or G
aggtctgggctgttttcttatgacnggaagaagtaggcacatggacacttgaagagtgagccaggtaggaagttttattgagtgatgaagcagctgttagcagaaaggagacatgggtgtggtatccctacccgaaggtcggagagttcccaatatggctaaccccgccgtgtttcatgggctcagaatacagagtgtgtgatgattggtttgtgagtatgcaaaaaagtttaaagtgaagacaccactctaaggtgtagaagatagtgtagaaaaccaattaggctagggtaggtatatataaactaggtaaaggatggggatcaatcagaggaaagtgtgccaaatgggaaggcaggttctcaatcttgttcgaggttttacccaggactgtttccagcttgaaggttggatttcaccaaggaaccgcccctatctgcctaggcctttgcctcctgcctctatcac

SEQ ID NO: 39428 - DNA, 481 bp, Homo sapiens
  misc_feature 22, 381: n = A,T,C or G
tatggccgggatagaaacagantatcaacttaattctgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatgggaaatgtggaaaatatcgtaggtaaaggaaactacctcatgctctgaaggttttgtagaagcacaattaaacatctaaaatggctttgttacaccagagccatctggngtgaagaactctatatttgtatggttgagagggcatggaataattggatttttgctggcaatagacacattctttattatttgcagattcctcatcaaat

SEQ ID NO: 39429 - DNA, 142 bp, Homo sapiens
ggctgtggttccacgcctgtattcccagcactttgggagggagaggcaggacaatcgcttgaacctgggaggcagaggttggagtgagccgagattgtgccactgccctccagcctgggcgacagagcaagactctgtcttt

SEQ ID NO: 39430 - DNA, 468 bp, Homo sapiens
  misc_feature 407, 426: n = A,T,C or G
gcataaaagttagtgcttattctgtgaatctgacccataccattattttctttttgatctgggtctctggcattggggcgatttgtaaaactatattaaagtatttgggggtaatttactaaacaggtcatagttgtccaaaagaaatattgaagtatcctgagagttcaaatgtgatcagtggttattgtacttaaaacaattacgtagtaacatcatccccatgttttcaaagtagtattgaattaggctattttggtccttatagtaagcatgggttttcatacctttctgataaatctgactgatgataggacttggactaatatgttggcgttaaatattatttgaatctggtaagaaagaaaatatattgtatgcttttattagaaatagcaaatatcagnttatttcatcatagccagntttgccattttatagacaaaaacttgacacttttggagagtt

SEQ ID NO: 39431 - DNA, 254 bp, Homo sapiens
  misc_feature 85: n = A,T,C or G
aatccacgacttcttattctccttgaaggaaagcccagaaaagtttcagattgaagccaattttcccaggcgagtgctgccctgnatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcgggtc

SEQ ID NO: 39432 - DNA, 500 bp, Homo sapiens
  misc_feature 6, 10: n = A,T,C or G
ctcccngggnaattcggccttatggccggcaaggctccagggtttggtgacaatagaaagaaccagcttaaagatatggctgttgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgtttgaagtgaatgaaaagaaagacagagttacagatgcccttaatgctacaagagctgctgttgaagaaggcattgttttgggaggggggttgtgccctccttcgatgcattccagccttggactcattgactcca

SEQ ID NO: 39433 - DNA, 471 bp, Homo sapiens
  misc_feature 414: n = A,T,C or G
agggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgaattaatggnggacatcattaaagatctaaatacaaaggatatacagtcttgaatctaaaataattt

SEQ ID NO: 39434 - DNA, 144 bp, Homo sapiens
catgttatattttcttttaagactttaatttagtaattttatatttgggaaaataaaggtttttaattttatttaactggaatcactgccctgctgtaattaaacattctgtaccacatctgtattaaaaagacattgctgacc

SEQ ID NO: 39435 - DNA, 227 bp, Homo sapiens
  misc_feature 56: n = A,T,C or G
gtgaggcatatcctgtcggggtgacgggcccatggggcggagctcgtccgcatggngctgaatggctgaggaccttcccagtctccccagagtccgtgcctttccctgtgtgaattttgtatctagcctaaagtttccctaggctttcttgtctcagcaactttcccatcttgtgtctcttggatgatgtttgccgtcagcattcaccaaataaacttgctctctgt

SEQ ID NO: 39436 - DNA, 469 bp, Homo sapiens
  misc_feature 18: n = A,T,C or G
gtcttcacttctcctttnaccctttacttcttccgagttgaacggcttactttccttcgctcactaggccatttcatggcttgtgtttgcctgaaatacaactctttccctccctggtctacacctgctcaccctgaaagaaatacctctgagcccactttctttcttggaagcattttatgactcttatttctgttatcaacacagcttttatttatgtctccatgtatcctttgaagaaacacaacttttcaggttctatgttttatttgcattcttagtgtctggcacattgtctgacacagtgtaaaagctgagtagaattttgcctgatagcagatgtgcctgaagtgagggtgtccaaaatttcattaaatgacgactgctttaatatgaattcttggctaaggcaggagaatcgcttgaacccaggaggcagaggttgcagtgagccgagatcacaccactg

SEQ ID NO: 39437 - DNA, 143 bp, Homo sapiens
aatgtcattgctaaaaaataaataaaagctagatactggaaacctaactgcaatgtggatgttttacccacatgacttattatgcataaagccaaatttccagtttaagtaattgcctacaataaaaagaaattttgcctgcc

SEQ ID NO: 39438 - DNA, 442 bp, Homo sapiens
ggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaacctagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcg

SEQ ID NO: 39439 - DNA, 266 bp, Homo sapiens
  misc_feature 3, 7, 38, 71, 93, 157, 160, 223: n = A,T,C or G
tcnggangaaggctgcatcccaccagtcgagacttccngggatgtggccggggagcagtcacatgctgtanctttcatgagcacaggcatcangtcaggcatatgtttgtcgactggaatggcgccaaatcttaaaggcagaccacgcaaaaagaanccntgcccacaaagaagagattcattcagtggtgttaaggattccaacaacaatctccgatggctnagccgttgccaaggtgaaatgtgaggccaggtcagccttgacc

SEQ ID NO: 39440 - DNA, 467 bp, Homo sapiens
  misc_feature 3, 45, 126, 224, 272, 286: n = A,T,C or G
ggntcctattcttcgactgtattgacatctgtagtggatcatgtngcttcttcattcttaccaattttattagaatcaaacttcttgttatttgcatactattatctactatagattctcagcttnagaaaatgactatgatacataaagaccactaggtcaacttaaaaaaccctttctgtgaatttatacatgtatgtatatatgtaaaaacactgttgatntgcaattctgtctttccatagaaatgaactttttctatcgaaattggntaacttaaatattngaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagac

SEQ ID NO: 39441 - DNA, 469 bp, Homo sapiens
  misc_feature 4, 6: n = A,T,C or G
gagngntaagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaactt

SEQ ID NO: 39442 - DNA, 189 bp, Homo sapiens
ctggagaaagattgaccttaagttcattgacaccacctccaagtttggccatggccgcttccagaccatggaggagaagaaagcattcatgggatcactgaagaaagaccgaattgcaaaggaagaaggagcttaatgccaggaacagattttgcagttggtggggtctcaataaaagttattttccac

SEQ ID NO: 39443 - DNA, 367 bp, Homo sapiens
gttctaacctttttggttatgttgtttcattatgatggagaagtactcttttctacgactagtgaggagtctattattcttcccagttcagctcatatcccgttctccatgaaattcctgccttcccctgtattaaactgactctgctaaaattctgtggtactttctattatattactaacacttaatcagtcctcagtatctatatatcttgcacatattatgatttatattgctttatttcctggaacgttaatagtctgctcaataaatacttagatttcatgtctatccatataattgctaaattatttcagggccttttttggttttaatctagaaatcttcctttcatattcagagttca

SEQ ID NO: 39444 - DNA, 467 bp, Homo sapiens
  misc_feature 54, 57, 91: n = A,T,C or G
ataaaaagtatgtttacatttaaaaaattagtagataacttcctttctttcagngcncaatttcattttgacttgagtcaacttttgtttnggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttaccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagagga

SEQ ID NO: 39445 - DNA, 369 bp, Homo sapiens
catagtgactcacatctgtaatcccaacactttgggaggccgaggcgggcacatcacttgaggtcaggagttcaagacagcctggccaggccaggcacggtggctcacgcttgtaatcccagcactttgggaggccaaggtaggcggatcacgaggtcaggagatcgagaccatcctggctaacatggtgaaaccccgtctctactaaaaaatacaaacatttagccaggcgtggtggtgggtgcctgtagtcccagctacttgggaggctgagacaggagaatggtatgaacccgggaggcagagctagcagtgagcggagttcacgccactgcactctagcctgggcgacacggcgagactccttct

SEQ ID NO: 39446 - DNA, 256 bp, Homo sapiens
aggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaagcaataaatactgattatt

SEQ ID NO: 39447 - DNA, 260 bp, Homo sapiens
acacttcctcacctactgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaaatcaatggacattgctgtttgtaaat

SEQ ID NO: 39448 - DNA, 284 bp, Homo sapiens
  misc_feature 36: n = A,T,C or G
acaggctgatcgtccacaacggttactgcgatggcngatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtca

SEQ ID NO: 39449 - DNA, 210 bp, Homo sapiens
atgtttaatttaacccgtatatcaaactgtcatcatgtccaagctatatacatatcatgtcatcagcattttaaagttaccaggagaattcagtgggtactttaaagtccatctgaattcaggctagccacatttcaagttgctacatgtgactactggctaccaaagtagacagcatagctctaaaaaaaaggtagacagactcatccc

SEQ ID NO: 39450 - DNA, 265 bp, Homo sapiens
atgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtggctgacaggacccactctttcattgaaaggtgatgaaaatcaaataaagaatctcttcacatg

SEQ ID NO: 39451 - DNA, 180 bp, Homo sapiens
  misc_feature 35: n = A,T,C or G
ggtgaaaccctgtctctactaaaaatacaaaaatnagccaggcttggtggcatgcgcctgtagtcccagctacttgggaggctgaggcaggagcatcacttgaacctgggaggcagaggtggcagtgagtcaagatcacgctgctgcactccagcctgggtgacagagcgagactccatc

SEQ ID NO: 39452 - DNA, 224 bp, Homo sapiens
cagcctcccaagtagctgggattacaggcatgtgccaccacacctggctaatttaccatgttggccaggctggtctcttaactcctgacctcaagtgatccacctgccttggcctcccggagtgctgggattataggtgtaagctactgtgcctggccctggactcagtttttctggattaaacttatgaaatattgagtacaccttttaagtttatactgtat

SEQ ID NO: 39453 - DNA, 113 bp, Homo sapiens
  misc_feature 51: n = A,T,C or G
gggggggaatggagagtgattgctaatgagtatagagtttctttttggagngatagtatctagaattacatgggggggatggttggccaattttaatatactaaataccactt

SEQ ID NO: 39454 - DNA, 159 bp, Homo sapiens
gtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatg

SEQ ID NO: 39455 - DNA, 413 bp, Homo sapiens
  misc_feature 409, 412: n = A,T,C or G
gttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcattggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggnggng

SEQ ID NO: 39456 - DNA, 474 bp, Homo sapiens
agatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctca

SEQ ID NO: 39457 - DNA, 479 bp, Homo sapiens
agaattaaatgggtttttgttgccatggagactgcatttatataaatgtagcctgtagcttaagttaactaaacctaatgctgctgttaaaaacagtttattttaatattaaaatacagttgattagcaacagcggtgctggtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaac

SEQ ID NO: 39458 - DNA, 393 bp, Homo sapiens
atacatatttaatttagagtctagattcagcagaaggctgagaaaataattggcatcagaataaataagttagagcaataatgtcatagtgtcagagtagtaggcagagtttctaagactactgctgtactgatgctgtctccctctctttgtaaaccataagatctacttcttacttcacagctgtccttcaaggttggctgatttctttagaaaatgcctattcttacttactgtatgatttcaaaacacattgggtattgatagttcaaaaatctaaaaagcaggctgggcatggtgcaatcccagcactttgggatgctgatgtgagaggatcgccttgagtccaggagttctggaccagccctagcaacatggtgagaccctgttgct

SEQ ID NO: 39459 - DNA, 129 bp, Homo sapiens
  misc_feature 22, 40: n = A,T,C or G
aagacaaatgggactgatgtcntcttgagctcttcctttnttttgactgtgatttatttggagtggaggcattgtttttaagaaaaacatgtcatgtaggttgtctaaaaataaaatgcatttaaactc

SEQ ID NO: 39460 - DNA, 179 bp, Homo sapiens
gtggtgaattgtgaaattactttcgtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaacctg

SEQ ID NO: 39461 - DNA, 135 bp, Homo sapiens
ataaatccgagtaatggaaggaattcctatttttgcctttggattttattttatttttttgtcccgaatttgccgttgaaagaatttttgtgaactttccaatgtgcatagtatatatcaagatacaataaattc

SEQ ID NO: 39462 - DNA, 434 bp, Homo sapiens
  misc_feature 15: n = A,T,C or G
aactgagagaaagantctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatg

SEQ ID NO: 39463 - DNA, 465 bp, Homo sapiens
gttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtgggaag

SEQ ID NO: 39464 - DNA, 235 bp, Homo sapiens
  misc_feature 233, 235: n = A,T,C or G
caacactgcaccttatcccaggaacctgccctagtacctccagagtaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccaccgnan

SEQ ID NO: 39465 - DNA, 466 bp, Homo sapiens
  misc_feature 8, 28: n = A,T,C or G
gaaaaganaggtttctggtattcacagnaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccat

SEQ ID NO: 39466 - DNA, 208 bp, Homo sapiens
aagagatgcttacttagatttcccagctgtttgaaagctctgtatttggttataacggaaaactttgttaagggatgcttgatgttttgtgttttgtttctaaaggaagacagtgttttgttccttctttagaaaacttgaagaatagaataatgagtccaggattaatttgggataaagtcttttacttcataaattctgattctgg

SEQ ID NO: 39467 - DNA, 473 bp, Homo sapiens
  misc_feature 8: n = A,T,C or G
ctccaagnaaatatgggactatgtgaaaagaccaaatctacgtttgattggtgtacctgaaagtgacggggagaatggaaccaagttggaaaacactctgcaggatattatccaggagaacttccccaccctagcaaggcaggccaacattcaaattcaggaaatacagagaacgccacaaagatactcctcgagaagagcaactccaagacacataattgtcagattcgccaaagttgaaatgaaggaaaaaatattaagggcagccagagagaaaagtcaggttactcacaaagggaagcccatcagactaacagcagatctctcagcagaaactctacaggccagagagagtgcggagaagggggcaatattcaacattcttaaagaaaagaattttcaacccagaatttcatatccagccaaactaagcttcataagtgaaggagaaataaaatactttacagacaagc

SEQ ID NO: 39468 - DNA, 199 bp, Homo sapiens
  misc_feature 199: n = A,T,C or G
caggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggn

SEQ ID NO: 39469 - DNA, 468 bp, Homo sapiens
  misc_feature 26: n = A,T,C or G
ggaagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtaccacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatat

SEQ ID NO: 39470 - DNA, 458 bp, Homo sapiens
  misc_feature 53, 77, 116, 215: n = A,T,C or G
gtcttttggttctccttgcctgctcctgatgcttggaccccttttattgatcngagtgctctagaataatggatggncttggatgatggataaatagggacagggacagttaaatngggagcctttcttacaaccttgatgggatttttccccccaagtttccttctccactgaaatgccacactaatgcttgttggattcatgaggtggccacnaccaatgtgttgttttgttgttgttgtttttttaagcttcccttgagagaataaatggtaatggagagaactatttaacaaggtcctggtttctcttgcaacacagtagctaaacttgcctgcttttatatgcatttttgtaagggatcaagcttggtagacagtattagcggagaaacaccttgatcttggtttgcaagcccttctcccatcagtcctagattaggccctgttcagccatgc

SEQ ID NO: 39471 - DNA, 332 bp, Homo sapiens
  misc_feature 331: n = A,T,C or G
attgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgatatcatcatcttgttttctttttgtaggtataaataaaaacactgttgacant

SEQ ID NO: 39472 - DNA, 467 bp, Homo sapiens
gttcacactagcacagtgcaccttcaatgcaaagatctcatcaaaataattcacatggtgggatattttagaaggatgaccaggctagtttgtagtaagaaaaaatcaacaagactaggtcaggaattctttttttgtctacaggcttgctatagaagatattgaaaatcatctacctaattacctttattttatcaggttgtgtattaaatatcacgtctgggggaagaaaatgtgatatgtgattacagacctttcctggtacaacatagtacgtttcagattaactcaaggtattgtggtgatattgcggtcaaagccaggtgattaaagagtcattctttgaaacaaatatctgtgcaatcaattaagaaattaatttgcaaattttatttgcttagagtaattgatatatcatttccttttacaaacaaatataaagaaaacttaactaaaaatactgcata

SEQ ID NO: 39473 - DNA, 398 bp, Homo sapiens
  misc_feature 23, 384, 395, 397: n = A,T,C or G
caggacagtctcgtcgttcgagnaagcgattcctcgggatacatccagagctttaaaacgatcagacccttcgaccaataatccgactggtaaacatctaaactgaggacatcattttcaatcagagaaagctctgtgcctttctcatgtaactcaaggtggttttgagggagcagaagattggcaccaacttacacttccagaagagagtggttcaggaaattactatgcttaatagaatattaaactttagaaaaatgaattttatgtgtgtttttaatggcataggaaaggtggggttttttaacatatacgaaattagaaatccaatatggcttcagctgtttttcacaaacatatggagatagaaaaaaaaaaaatccnggaataatatntnc

SEQ ID NO: 39474 - DNA, 204 bp, Homo sapiens
  misc_feature 177, 202: n = A,T,C or G
cagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatgnacagttatctaagttaatttaaagntg

SEQ ID NO: 39475 - DNA, 141 bp, Homo sapiens
acagtgtggccgagcagatggctatgtgctagagggcaaagagttggagttctatcttaggaaatcaaggcccgcaaaggcaaataaatccttgttttgtcttcacccatgtaataaaggtgtttattgttttgttcccac

SEQ ID NO: 39476 - DNA, 459 bp, Homo sapiens
  misc_feature 7, 20, 26, 28, 38, 56: n = A,T,C or G
cacaagnaggcgccgaagcnaagatngnagctcctgcncctcctaaagctgaagcnaaagcgaaggctttaaaggccaagaaggcagtgttgaaaggtgtccacatgccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaagctgtgaagaagctgtatgacattgatgtggccaaggtcaacaccctgattcggcctgatggagagaagaaggcatatgttcgactggctcctgattacgatgctttggatgttgccaac

SEQ ID NO: 39477 - DNA, 288 bp, Homo sapiens
gaggcattgaggcagccagcgcaggggcttctgctgggggggcaggcggagcctgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaga

SEQ ID NO: 39478 - DNA, 224 bp, Homo sapiens
gcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatatc

SEQ ID NO: 39479 - DNA, 312 bp, Homo sapiens
ggaacattgtatagtttagatgtgggaattactattaagaatcgtggccggatgtggttctgggaggctttgggaggctgaggcgggtagatgacctgaggtcaggagttcgagaccagcctggccaacgtggtgaaaccttatctctactaaacatgcaaaaaattagccgggcgtggtggtgtgctcctgtaatcccagctactcgagaggctgaggtgggaaaattgcttggacctgggaggcggaggctgcagtgagccgagattgcgccgctgcactcctgcctggatgacagtgagaccctgtctc

SEQ ID NO: 39480 - DNA, 139 bp, Homo sapiens
  misc_feature 139: n = A,T,C or G
atctaaagaaaatataaataccttttatagccatttggttttctaataggcaatagtatatttcaagctcagaaatctaagaataagcctttggtcttaactgtattcaactttttaccttgagatttcaatatatgtn

SEQ ID NO: 39481 - DNA, 118 bp, Homo sapiens
gctacttgggaggccgaggcaggagaatcacttgaacctgggaggcagaggttgcagtgagccgagattatgccattgcactctggcctggcgacagagcgagactccgtctcaaaac

SEQ ID NO: 39482 - DNA, 466 bp, Homo sapiens
ggagcatttaagaagctcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcattaga

SEQ ID NO: 39483 - DNA, 347 bp, Homo sapiens
  misc_feature 10: n = A,T,C or G
ggaagcgagnatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataacctggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctgggtttta

SEQ ID NO: 39484 - DNA, 164 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatg

SEQ ID NO: 39485 - DNA, 364 bp, Homo sapiens
gggctcggacctaggtcgcggcgacatggccaaacgtaccaagaaagttgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgccttggacgtacgataccacttccgctgtcacggtaaagtccgccatcagaagactgaaggagttgaaagaccagtagacgctcctctactctttgagacatcactggcctataataaatgggttaatttatgtaac

SEQ ID NO: 39486 - DNA, 227 bp, Homo sapiens
  misc_feature 85: n = A,T,C or G
gaactccatcagggacaaggcctagatatttacgggagggataattacacttgtcccactgaagaagaatataaaaggctatggngctgcagaaaacaggtggactgtttggattagcagtaggtctcatgcagttgttctctgattacaaagaagatttaaaaccgctacttaatacacttgggctctttttccaaattagggatgattatgctaatctacactcc

SEQ ID NO: 39487 - DNA, 214 bp, Homo sapiens
agtgaagtaacactgcaggaagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatacactccagcctgggtgacagagcaagactccatccc

SEQ ID NO: 39488 - DNA, 135 bp, Homo sapiens
  misc_feature 39: n = A,T,C or G
gtatgtccacgggtaaaaataagattgaaatgtattgcntagtggcttgtgcctgtggttccagcacttcggaaggccgaggtgggtggattgcttgagctcaggaattcgagaccagtctgggcccatctttac

SEQ ID NO: 39489 - DNA, 163 bp, Homo sapiens
gaaaagacagcccaccaaatgggagggaatacttgcaaatcctgtatctgataaagatctggtattcataatatgtaaagaactcttacaactaaatattaataatgaaaagacaaataacccaactgaaaaatgggcaaagtatctgaatagacatttctcc

SEQ ID NO: 39490 - DNA, 461 bp, Homo sapiens
gcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacagtctgaaggaatggctcccgtgtcttcatctacggtcagttctgtaacgaaaacttctgggcagcagcaagtgtgtgtgagccaggccaccgtgggaacctgcaaggctgccacccccaccgtcgtc

SEQ ID NO: 39491 - DNA, 324 bp, Homo sapiens
ggcattgttgtaaacaagggtaagattcttgccaagagaattaatgtgcatattgagcacattaagcactgtaagagccgagatagcttcctgaaatgtgtgaaggaaaatgatcagaaaaagaaagaagccaaagaggaaggtacctgggttcaagtgaagcaccagcctgctccacccagagaagcgcactttgtgaaagcttgtgggaaggagcctgagctgctggaacctattccctgtgaattcatggcatcataggtgttaataaaataaaataaaataaaataaaataaaataaaataaaataaaagacctctggct

SEQ ID NO: 39492 - DNA, 465 bp, Homo sapiens
gttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatattttagatttctctagactctagtggaagacctttggaaaggccatgccaacccgtgcttgtactgctagaagca

SEQ ID NO: 39493 - DNA, 465 bp, Homo sapiens
tacgtttgagagtgaaatagtcattaattgtgtgactagtacataagaattcatactcatttgtgtcaacaccctgaaatctaaattgtcaattgccttgctattttgattccagacttcacttggtagaggacattagtcttttgatgtgaacaataatgagctgaagaataagaccaaataatggaaggtgttttcttctagctcatgaaagaaaagatgagaatttagaggtctcagaaatgcaagaaatccaattgtcatgtgggcacataggaaagaaaaacaagtatgagtattcttttattctttcttcccggtgttttttgagtgttactcttcaaaatggttacaaaactgcaaatattatggtagaaatcacatttgtcctttttaaaaaaataaatgttttttggcaacaaatcgacattttacattattcccatataagatgaaattctaagc

SEQ ID NO: 39494 - DNA, 269 bp, Homo sapiens
  misc_feature 11, 36, 49, 72, 106, 132, 141, 192, 193, 220, 244: n = A,T,C or G
atagactgtgntgatatagtctggagtcttgctttngggtcatcagttncagaaaaacagagtcgctgtgtnaatatagaatggcatcgcttcatgatttggacangatcagctacttcttgctacagggtngaacaatgngcgtatcaaaatatgggatgtatatacaggaaaactcctccttaacttggnngatcatactgaagtggtcacgagattnaacttttgctccagatggaagctngatcctggcgtcagcttcaagagac

SEQ ID NO: 39495 - DNA, 152 bp, Homo sapiens
gtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 39496 - DNA, 402 bp, Homo sapiens
caggtttaggttgatgtcatctaatagtgccagaattttaatgtttgaacttctgttttttctaattatccccatttcttcaatatcatttttgaggctttggcagtcttcatttactaccacttgttctttagtcaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttattttttgattgcacttaaattttgtataatttgtgtttctttttctgttctacataaaatcagaaacttcaagctctctaaataaaatgaagc

SEQ ID NO: 39497 - DNA, 477 bp, Homo sapiens
aggaaaggacattttcgacatacaaggcttcaacaaaaatgtccatctcatacaccctttctcagaaagccaccagaagatgtgcttcaccaaaatgaaggaggagtaaatgaagaaagaggaagacatgggacgcaggaagcagataatccaatacaggaaagaagtgaaggaatcacttagatcagggctggcagacttttcctgtaaagggccagatagtcagtatccctgtcacagctactacactgtccttcaggtctgtcttaaagaagatgctaagtgccaggtgtggtggctcatgcctgttatcctagcactttggcaggccgaggcaggtagatcgcttgaggtcaggagttcaagaccagcctggccaacatggtgaaaccccatctctactaaaagtacaaaaaattagctgggcctggtggcgggcacctataatctcagccacttgggaggctgaggcaggag

SEQ ID NO: 39498 - DNA, 468 bp, Homo sapiens
  misc_feature 408: n = A,T,C or G
gattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggnaatgttttcataaattattgcattaacatacaattgccatttaattatgaagtccatcag

SEQ ID NO: 39499 - DNA, 466 bp, Homo sapiens
ggatacggaaatgaagaggttggatcaagaacaaggccctgaggagtctcagccagaaactgacacctcagacatggatcctttagttggtttcaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtataca

SEQ ID NO: 39500 - DNA, 251 bp, Homo sapiens
agcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagct

SEQ ID NO: 39501 - DNA, 245 bp, Homo sapiens
  misc_feature 66: n = A,T,C or G
caagaaaggcaaaccagagctcagaaaaaaggtacatccagcagtggtcattcgacaacgaaagtnataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 39502 - DNA, 472 bp, Homo sapiens
  misc_feature 21: n = A,T,C or G
atcgtatgtccgctatccagnaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaagaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgctt

SEQ ID NO: 39503 - DNA, 392 bp, Homo sapiens
  misc_feature 6, 29, 32, 35, 50, 53, 64, 104, 146: n = A,T,C or G
gaaggncccactgcctataacagaagtancanganctgccatattgccanatntctctcttgcngctaggatgcgtagacagcctagcctcccctccttaatcncatacagaagagttctctgtgttatgacagcaggtacctgtntttctggaaactatcttaatgctttcttttcctttccattatatgcaataaaaatcatcataagatgctctaagtaatatagtttttataaaagttagtatattctgcacttaaagaagagcgacatttggagacatttctaagaagtcctaagtagcttgaatgctggtacattgtcctaaaattagtaatggttatgaaatccatctttgccagaaaacacttctgggcattttatataaaatg

SEQ ID NO: 39504 - DNA, 382 bp, Homo sapiens
cgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacga

SEQ ID NO: 39505 - DNA, 104 bp, Homo sapiens
acagataacgctttgattgctcgatctcttggtaaatacggcatcatctgcatggaggatttgattcatgagatctatactgttggaaaacgcttcaaagaggt

SEQ ID NO: 39506 - DNA, 290 bp, Homo sapiens
aaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattc

SEQ ID NO: 39507 - DNA, 379 bp, Homo sapiens
  misc_feature 24, 365: n = A,T,C or G
agctggattccaaacaggtacctnattgtctctgagctaatgtttatatttttccattcaggcaccgaaatagttaatatttaaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggnttgatagcaccatg

SEQ ID NO: 39508 - DNA, 492 bp, Homo sapiens
  misc_feature 1, 28: n = A,T,C or G
naaagaacctacctggaagaaaaccagnacgaattttggattttggcatagaacatttctctgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatctccaggtttgtgtactgtaaagattataatgtcttcatttatttagcatgca

SEQ ID NO: 39509 - DNA, 400 bp, Homo sapiens
  misc_feature 7, 19: n = A,T,C or G
catgacnttgcaacccagnattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatac

SEQ ID NO: 39510 - DNA, 206 bp, Homo sapiens
  misc_feature 5, 36, 40, 204: n = A,T,C or G
gaatntaacctatttatattatcctaactactaccncatncctactactcaacttaaactccagcaccacgaccctactactatctcgcacctgaaacaagctaacatgactaacacccttaattccatccaccctcctctccctaggaggcctgcccccgctaaccggctttttggccccaaaatgggggccttttattcggnag

SEQ ID NO: 39511 - DNA, 332 bp, Homo sapiens
  misc_feature 22, 49, 67: n = A,T,C or G
caagaagtaacccatttaactntttaccagctggttggccccactcagnatttatcaaagggttacntgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttg

SEQ ID NO: 39512 - DNA, 121 bp, Homo sapiens
cgtagttccgaccataaacgatgccgaccggcgatgcggcggcgttattcccatgacccgccgggcagcttccgggaaaccaaagtctttgggttccggggggagtatggttgcaaagctg

SEQ ID NO: 39513 - DNA, 257 bp, Homo sapiens
cagtggccggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaacga

SEQ ID NO: 39514 - DNA, 439 bp, Homo sapiens
  misc_feature 34: n = A,T,C or G
agcaaccctaggtggttgatttgaaactgtgaangtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtattttt

SEQ ID NO: 39515 - DNA, 158 bp, Homo sapiens
acaaaaattagccggacgtggtggcttgtgcctgtaatcccagctagtcgggaggctgaggcaggagaatcgcttgaacgcaggaggtggaggttgcaagtgagccgagattgcgccattgcactccagcctgggtgacaagagcgaaactccatctc

SEQ ID NO: 39516 - DNA, 497 bp, Homo sapiens
  misc_feature 1, 5, 43, 220: n = A,T,C or G
nggcngggagaagaccatgttcataagaaaaaagaaagatttntggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgntcttcccaaaccaccaagccactgggtccctgtttcctttaatccttcagataaggaaataatgacatttcaacttaaaaccttacttaaagtacaggtataaaataagacaaatatttaaatttagttatgttcacgggtagttgtcaattggtctgaaacaaatttgctagggaatctatttgtgtagaactaattaatgtaaaaaaaatagaccatctcgtgttgtgtgcactgtgatataatggtagtatcagtgcaacttaaactaatgatt

SEQ ID NO: 39517 - DNA, 296 bp, Homo sapiens
caattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagaga

SEQ ID NO: 39518 - DNA, 470 bp, Homo sapiens
  misc_feature 33: n = A,T,C or G
attcaccattcttaaagaattttcaacccagtntttcatatccagccaaactaagcttcataagcaaaggagaaacaaaatccattacagacaagcaaatgctgagagagaattttcaccacaggcctgccttacaagagctcctgaaggaagcactaaatatggaaaggaaaaactgttagcagccacttgcaaaaacataccaaaatatgaagaccagtgacattgtgaagaaactgcatcaactaatgtgcaaaatagccagttaacatcatgatgacaggatcaaattcacacataacaatcttaaccttaaatgtaaatgagaaaatgcctcaattaaaagacacagactggcaaattggataaagagtgaatacccattggtgtgctgtattcaggagatccaattcatatgcagagacacacatagcctcaaaataatgggatggaggaatatttaccaagca

SEQ ID NO: 39519 - DNA, 469 bp, Homo sapiens
  misc_feature 6, 7, 33: n = A,T,C or G
gctctnncaagtcgcgagcgaacgaccaagtangtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaac

SEQ ID NO: 39520 - DNA, 477 bp, Homo sapiens
  misc_feature 6, 30: n = A,T,C or G
atagcncacattgagtaagtgtgttttagncttatgtattaatgagtctttatttctgaagcccaagtaaattgttccaagttgagatatctgaaaaagtaggaccaattttccctccactgtcaccagctgtggctaaaccagtgcgtggtacaaggagagaacccagccatgtctgtccagccccctttttaccatgctcactttcaggagcaatcaggaaggtgcctggagacatagtgatgacaagaagaccaccagtagttggtacacttattctaggattctctgctgtccttaacctgtcatttttcttgctctagcctgggtgacagagtgagacgctgtctcaaaaacaaaaaacaaaacaaacaaaaaaaccccaaagccttaaattgcaattttgttagaaaagtaacatttgaaaccttgtatcaaatgtatttattataaaaataatacacgcttttaagcact

SEQ ID NO: 39521 - DNA, 407 bp, Homo sapiens
  misc_feature 25: n = A,T,C or G
cggtttgttcaggaaatcagcaccnagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtg

SEQ ID NO: 39522 - DNA, 265 bp, Homo sapiens
  misc_feature 4, 6, 33, 35: n = A,T,C or G
aacnanaacatggtggccaaagtggatgaggtnangtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttc

SEQ ID NO: 39523 - DNA, 155 bp, Homo sapiens
tgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggt

SEQ ID NO: 39524 - DNA, 460 bp, Homo sapiens
attttgagataagatcttgcactccagtctaggccacaacaacaaaactccgtctaaaaataaataaataaataaaactgaatgaatataaacagaaaccacagatgctattacaggcgtgagccaccaagcccggcctaaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcatttaaaccatgggaaagaacagcttttaaaaaaaaatcgcttctcagccttttggctaagctcaagtgt

SEQ ID NO: 39525 - DNA, 352 bp, Homo sapiens
  misc_feature 6, 7: n = A,T,C or G
taattnncagtggtaggatgaaacaatttggttttagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaag

SEQ ID NO: 39526 - DNA, 499 bp, Homo sapiens
  misc_feature 25, 101: n = A,T,C or G
cacggcccagcttccttcaaaatgnctactgttcacgaaatcctgtgcaagctcagcttggagggtgatcactctacacccccaagtgcatatgggtctgncaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacatta

SEQ ID NO: 39527 - DNA, 436 bp, Homo sapiens
  misc_feature 26, 252, 399, 436: n = A,T,C or G
gtccaccttccagcagatgtggattngcaagcaggagtacgacgagtcgggcccctccatcgtccaccgcaaatgcttctaaacggactcagcagatgcgtagcatttgctgcatgggttaattgagaatagaaatttgcccctggcaaatgcgcacgcctcatgctagcctcacgaaactggaataagccttcgaaaagaaattgtccttgaagcttgtatctgatatcagcactggattgtagaacttgntgctgattttgaccttgatttgaagttaactgttccccttggtattaacgtgtcagggctgagtgttctgggattcctctagaggctggcaagaaccagttgttttgtcttgcgggtctgtcaagggttggaaagtccaagccgtangacccagtttcctttcttagctgatgtctttggccan

SEQ ID NO: 39528 - DNA, 421 bp, Homo sapiens
  misc_feature 23: n = A,T,C or G
attaagtaattgaaataaaattnggaagctatttgttaaactccttggatcacagtgtatttagattttgtttgttgagaatactgatcaacaatattcttaggttcttggttactttgccccaggcacctcccagattgataaaggagaaaaagttccattctattttgaggacagctttctgggtagatgaaaacctgcatgaaataattgggttgccaagtatttcttgttactctgcttccattccaggtgttagaggcaccaaaattctgccactttaatcacagcttatgctcctcttaaagaaaacaatctgctataaaaaagagtaggtgaagtgtagtcctcatataattctttctttcctcgtccccttcttcatggagccatgcaagaactagctctaaatattttcaga

SEQ ID NO: 39529 - DNA, 409 bp, Homo sapiens
  misc_feature 153: n = A,T,C or G
taaaaggtttctaaaacatgaccgaggttgagatgaagcttcttcatggagtaaaaaatgtatttaaaagaaaattgagagaaaggactacagagccccgaattaataccaatagaagggcaatgcttttagattaaaatgaaggtgacttanacagcttaaagtttagtttagaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaag

SEQ ID NO: 39530 - DNA, 211 bp, Homo sapiens
  misc_feature 30, 32, 210: n = A,T,C or G
atacttgggctgtattaccttcctacagantnactttcactaggtttagtaattagctatagcttcagccttttgttttgttttgttttgttttgttttgttttgtttttgaggcaggagaatcgcttgaacccaggaggcggaggctgcagtgagcccagattgccccactgtactccagccagggagacagagtgagacaccatcccng

SEQ ID NO: 39531 - DNA, 491 bp, Homo sapiens
  misc_feature 8, 57, 82, 489: n = A,T,C or G
gaaggccnttctttctatattctggatattattcccctatcagatatatgatttgcncatatcttctcttattccataaggntactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaaggttggttccatatctttgcaattctgaattgtgctgtgatcaggtgtctttttagtataatgatttactctcctttgggtagatacccagtagtgggattgctggatcgaatgggttttataattttctattttaccacagtttctctctgcatttttcctctttgaccactaaccatgnga

SEQ ID NO: 39532 - DNA, 188 bp, Homo sapiens
  misc_feature 46, 99: n = A,T,C or G
aatccttttctttcatgaaactctcattctattttatatttctggnttgttcttgttcccatgtgagaaaacatacagtttctgaaaattcaaaatggncatcaatgctttggactttacataattatgtattagagaaggtgcaacctgtacattacttaatatactatgaacataataggaataac

SEQ ID NO: 39533 - DNA, 500 bp, Homo sapiens
  misc_feature 23, 24: n = A,T,C or G
tgcgacttgtgttgggactgctnntaggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactt

SEQ ID NO: 39534 - DNA, 258 bp, Homo sapiens
  misc_feature 250: n = A,T,C or G
agcaatcagtgagtggtatttaccattcccctggctttgtgaaagcatattatttttctgaaaacttctccaacctaagctgagagccccatagatactaatctgaagttaataattaacataattaatatgtactatgcctaaatatacatctcccctcttccaaatgtttgattcaaaactagcattttcaccagcctgggcaacatagcaagatcttatcgctacaattttttttttttttaattanccaggcat

SEQ ID NO: 39535 - DNA, 460 bp, Homo sapiens
  misc_feature 6, 33, 304: n = A,T,C or G
gagcancgctctatctaacacaatataataggntatttaaaaactgaggttaattgccttcacatgtacttctatgtgtgttcctcaagaaaattcctcccatgcactgtggaaatcagtctcgtttcttgtctcgctttgtgctaaatgtcagaactacatcacaagcgcaaaaagtatttcctcagacgttttggtccactgacattttaaaaattattttgttgaatttgaatcttaacgaaacagatttttgccaatgacaattcagacctatttatgaaaattattctttctagtttgnttttaagtgcaaatataatttaattatcattgtaatttttacttgacctttctctcatcccattttttccaagatcttggaagttttctctcctctaatatgctgtcatgttttgtcatcatatttttcttttaatgtttttcaatttttttgaga

SEQ ID NO: 39536 - DNA, 414 bp, Homo sapiens
  misc_feature 19, 23, 183, 230, 239, 277, 347, 382, 386: n = A,T,C or G
gagggggcaggcggagctngagncaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtngcatgaggaaggaaaagataaaaggtttctaaaacatgacggaggtngagatgaancttcttcatggagtaaaaaatgtatttaaaagaaaatngagagaaaggactacagagccccgaattaataccaatagaagggcaatgcttttagattaaaatgaaggngacttaaacagcttaaagtttagtttaaaagttgnaggngattaaaataatttgaaggcgatctttt

SEQ ID NO: 39537 - DNA, 131 bp, Homo sapiens
accaacctaagcaagaggaagtgcccctctcaacctgtgcgggctgctgcgtcccaggactgagacgcaggccatgccccggcccctagccctcaggccttctttcttatccaaataaatgtttcttaccg

SEQ ID NO: 39538 - DNA, 466 bp, Homo sapiens
  misc_feature 38, 210, 366, 461: n = A,T,C or G
aatgaaccgtcagggtatttttccttctacttttagtnaactacgcttaccagtttttattgcccttatgactgacttcaaaaaagaatacagtgacctccagatcttgattctttgttgtccctaaacttaagtgcatagattcttttagttttaaaagttttattgcaactggggagacagataagatataacaaattaatgaccttnggaaaattacaaagcttaggaaatcttacagtcataatctgtagtctgtatgtttctgtttaccctttaggcagtacctggaagaatctttggactttacattttcttttctttcttattactgagaggatatttcagccttatttctaaaaaggnagatttcaacccaatttcttctccttcttaatcatacctaaaagtgaagagacctaccgttttttttctagtgtagatatgaaggagatgttagnttaga

SEQ ID NO: 39539 - DNA, 144 bp, Homo sapiens
atgaccacatctaatattctggctgctttggatacaatactcttgatttatgataattagttaaaatatattaaaaatattattagtaaaataaaatttcacacaataaaaaacaacatagagtacacatatttatatgtattt

SEQ ID NO: 39540 - DNA, 480 bp, Homo sapiens
tatggccggggaaaatccggctctggaataactgacaacatattcaagtattttagtgcagtgtcactctcattaagaagaagagaatcagtaaatctatgtgactctaaacattctaatgaaaaaaggaatattctgccaattatctcacatttctaaatatctggatattggccattgtaaagacaaaacacacagatgatggacttgtctttccacctctcatttgcatggtttggagcattgtacctccagccatagactctaaggcaatttatatttgcttcctcttccctcttgagagaaaacgaaaatcttatttttccaagcaattaaaactctcctgcttcagctaggatgaaagaattaggagttctgtctccttgtatctaattgcatgtttcatctttcttgttttaatgattgacagaaaactaataaactgagacatctttgaatccaggttgaatgtactctctt

SEQ ID NO: 39541 - DNA, 297 bp, Homo sapiens
  misc_feature 9, 10: n = A,T,C or G
aataatacnnaaatttaaaaatattatatatgggtttggctaaaggctcctttaaccacagcctcacatatacatcttgccatataaaaaacattattttggccaggtgtcatggctcacatctgtaatcccaacactttgggaggtcgaggcaggaggattgcttgagcctaggagttcaagaccagcttgggcaacatagcaagactcccatctcaaaaaataaagtaaaataaataaaaaattttaaaaaataataataaataaacatgttaatatacatattctaagagatga

SEQ ID NO: 39542 - DNA, 176 bp, Homo sapiens
aatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 39543 - DNA, 249 bp, Homo sapiens
  misc_feature 7, 21, 34, 35, 37, 62, 248: n = A,T,C or G
aacttcncatttgcccacagnaaccctctaaatnntncttgtaaatttaactgttagtccanagaggaacagctctttggacactaggaaaaaaccttgtagagagagtaaaaaatttagcacccatagtaggcctaaaagcagccaccaattaagaagcgttaagcttaaaacacccattacctaaaaaatcccaaacatataactgaactcctcacacccaattggaccaatctatcaccctatana

SEQ ID NO: 39544 - DNA, 110 bp, Homo sapiens
gaaaatattgtcaagagtttcagatagaaaatgaaaaacaagctaagacaagtattggagaagtatagaagatagaaaaatataaagccaaaaattggataaaatagcac

SEQ ID NO: 39545 - DNA, 500 bp, Homo sapiens
  misc_feature 3, 19, 117, 177, 341, 464: n = A,T,C or G
cgnagggaccaccagcttngacgacctcattgcgtgtgtgtcggcgcccgacagtctgcaaaaaatcgagagccttggttacaaccgacttatcctgcaaattggtagaggaacggnggtacctgaacccttcagtactgagtcgtttactctggatgtttacagggtacaaggatnccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagaaggncatctcttctattgtacctgcagcacgcttcctgggctgttacagtcaatggacttatcaacactgaaatgttatcctcctggccagccagaaaaattttctgcatttttggataaagttggnggattacaaaaataaacactaaactctcaacacttt

SEQ ID NO: 39546 - DNA, 435 bp, Homo sapiens
  misc_feature 428: n = A,T,C or G
tgtaccagtgcattaatttgggcccggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagttttttttagtgtaggagaaatacttttccattgtttaactgcaaaacaagatgttaaggtatgcttcaaaaattttgtaaattgnttatttt

SEQ ID NO: 39547 - DNA, 379 bp, Homo sapiens
cagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaaga

SEQ ID NO: 39548 - DNA, 206 bp, Homo sapiens
  misc_feature 24: n = A,T,C or G
gtccaagatagaatcttagttcanctttaaatttgcccacagaaccctctaaatccccttgtaaatttaactgttagtccaaagaggaacagctctttggacactaggaaaaaaccttgtagagggagtaaaaaatttaacacccatagtaggcctaaaagcagccaccaattaagaaagcgttcaagctcaacacccactaccga

SEQ ID NO: 39549 - DNA, 367 bp, Homo sapiens
  misc_feature 33, 353: n = A,T,C or G
gatcatctatcctttacggcaagggtacctacnttacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacctgcaactgtgattataactgtcaacactacatggagtgctgccctgatttcaagagagtctgcactgcggagctttcctgtaaaggccgctgctttgagtccttcgagagagggagggagtgtgacttgcgacgcccaatgtaagaagtatgacaagtgctgtcccgattatganagtttctgtgcaga

SEQ ID NO: 39550 - DNA, 430 bp, Homo sapiens
  misc_feature 6, 37, 62, 412, 423: n = A,T,C or G
gaaagncccaaagctgtcaattcaattctatattctnatgaagatatcttttgagaatgaanataaaataaaactggcatcttaggtgtagttgtgtatttggcatactgattaagaatgcgggctccggagacagaatctagatttgagtttctgcctgagtacctcttgtgatcatgggtgaattatataaattctctaacctcaatttccttatgtgttaaagacacttaaatgaaatatctaaactaatgagtagcaatgagaggatgcttcttaagcacttagtatctgcttggcatatggtaaattgttggaaaacattagttaccatttatatatgcatgtttttagctttcatagtaaatataaccaacctttatagaatttcgtattttatatttttatctgnttcatttttgntcaactg

SEQ ID NO: 39551 - DNA, 500 bp, Homo sapiens
  misc_feature 411, 477: n = A,T,C or G
gacattttttccccatggggaagcctcagcaaagttcactgtcttctttctctttaacctactctcagaaaaaaagacgaaaaggaaatacgaagtatagtaatgaagtgttaactaatagtggggctacataattgagtactcggattttgttgccagagttcttagaacaagaatgcgaacatgtcttatttcaaccatgtgcgtgctgtgttttgctttttttgtgtttgacaaaggggacaaaagaataaccccctaagtattaaggagtggagggaaaggagatgagcccccactccctgcgctcccttcctgggttgcctttgggtgtacaggttcatagggcttcctagaaacggctgcgttagggccgagggggtgaagacttggcaggacttcctggcagangcaaggactcccctgcctcccacctcatgaccattgggccttagcaaggcttagtgaatcctgagngggggcatctttagcctaaacct

SEQ ID NO: 39552 - DNA, 136 bp, Homo sapiens
cattatgcctatagggacacagacacattcagatgcctttgcagaaagagaagtcagggttcttgaagtcacaaagggaaggcatgaacaaatcttgcctctcagtcccacacaaggcagctgtctcacactatag

SEQ ID NO: 39553 - DNA, 449 bp, Homo sapiens
  misc_feature 23, 151: n = A,T,C or G
cgatcttttaaaaagaggttaanccgaaggtgattaaaagaccttgaaatccatgacgcagggagaattgcgtcatttaaagcctagttaacgcatttactaaacgcagacgaaaatggaaagattaattgggagtggtaggatgaaacantttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggag

SEQ ID NO: 39554 - DNA, 455 bp, Homo sapiens
  misc_feature 24, 25: n = A,T,C or G
gcacataagtgctaatgacgagtnnttggtcacacacaaaaaataaagatttactaacacatttatttaagaaaactcagacttaagctacatttggttcttaagtgtcttcttcaaaaagaaaggcaatcttgggtaattcctcacctgacttttagaagtgtgctagacctctggcttttaaaaatgttcagcctacgtttattttcattattcttgttcttcatggtatctttctttccttttctccttttttgagatccattaaggattttactgtgatttataaactttcttctggaatggtggttctccacctgaggtgattttattccacagggatcatttggcaatatctggagacatttttcattgttacagctgggagagggtgctacctggcatctagagggtagagccgagggccgctgctaaacatcctaccctgcagaaga

SEQ ID NO: 39555 - DNA, 160 bp, Homo sapiens
tcacctgcaaataatcattttaatttcttctttacaatcaggttggttttcttgaaggattaaaaaagatacagccattttcaaataacataatctattatccaaaatatttttcaaaaaatttcatatgggcctggtgctgtggctcacgcttgtaatc

SEQ ID NO: 39556 - DNA, 376 bp, Homo sapiens
  misc_feature 23, 24: n = A,T,C or G
gtgtggaagccggagccctgccnnatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacctggtagctggggtagaaaggaaaggccacttctcacttgcaggttgaaactgagtgaatgagcctgagacactagaggggtccttctttgcccaacatctcc

SEQ ID NO: 39557 - DNA, 500 bp, Homo sapiens
  misc_feature 23: n = A,T,C or G
cttaagtatatctggaaagcggnctgcccctggaggtggtagcaaggttccacagaaaaaagtaaaacttgctgctgatgaagatgatgacgatgatgatgaagaggatgatgatgacgatgatgatgatgatgattttgatgatgaggaagctgaagaaaaagcaccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatt

SEQ ID NO: 39558 - DNA, 201 bp, Homo sapiens
gcagatgtttcttgaatgctttgccaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaacg

SEQ ID NO: 39559 - DNA, 487 bp, Homo sapiens
  misc_feature 10, 330: n = A,T,C or G
aaattacccntggaaagagcatttttttagactttttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctggaattgtttaacaaaggggaaaatgtacataaacagataaagttaccataaattccatgaacttaaatctgtgattcattgccttaaaactttctctcttagaatttccataccgnatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaag

SEQ ID NO: 39560 - DNA, 106 bp, Homo sapiens
  misc_feature 23, 48: n = A,T,C or G
ctaaaaatctgtaaaatgttagnccttggtaattttttttctgctggnggatttacatattaaattttttctgctgggggataaacattaaaattaatcatgtttc

SEQ ID NO: 39561 - DNA, 433 bp, Homo sapiens
  misc_feature 25, 178, 386, 424: n = A,T,C or G
gcatatcagttatatctgtgatcangaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtnagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggngtgtgcacacaagtcttacttggaataaatttactggnacaaattcc

SEQ ID NO: 39562 - DNA, 451 bp, Homo sapiens
  misc_feature 16, 21: n = A,T,C or G
caggtggcctggaggngggcnccagggaagtaacagacacacgatgttgtcaaggatggttttgggactagaggctcagtggtgggagagatccctgcagaacccaccaaccagaacgtggtttgcctgaggctgtaacctgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttg

SEQ ID NO: 39563 - DNA, 326 bp, Homo sapiens
  misc_feature 174: n = A,T,C or G
gtgttgcttgggcagacgggatcagcaaccttttattaccaaagttaatggccatgaagttaattacaaagttaatgtattaatgagtttcagagattttttttctcttttttttcgctctttttctgaaggcacatattttctgtgccgactccacattgtaaagaaagtgtngacaagtttttttctgtaaagtccagatagtaaatatgttaggccttcttggcaatagggtctcagtcacacctgtttagctttttcctgtgttgcaaaagcagacacagagatggaaatgaatgacagtattccagtaaaaccatattatg

SEQ ID NO: 39564 - DNA, 496 bp, Homo sapiens
  misc_feature 179, 436: n = A,T,C or G
gatttgacaagatcaaagctgccggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgganagaacaagaaatgaagtggacagacttagccttacagtacctccatgagaatgttccccccattggaaactgacgcttggctcccttcttgtggatggattttctcaaagtacacagataaagcatggtttgtttcagtctccaaattcaaacctttgagtaataaatcagcactcaaaaatgtacacccatttagtttgtggtagcaaaagtgcaatgcgaaattgaatgagaaactgagatttctcagtaatggngaatatttcgctctttaaacctaaaactcttcattgagtagcttatatttgaacatgatt

SEQ ID NO: 39565 - DNA, 496 bp, Homo sapiens
  misc_feature 24, 176: n = A,T,C or G
ccaaagcatcttaacctgtgaccntttcaagctaccctccattcaaatagtaggtccttagagtgagacaatgagatgacagacaagattttactgagtttgcaaatctgattttttagttagtttgttgatcaaaataaattgcaaactgagaatactttggaaacctgataatntcatttatcctttgaaaaaaatttgcaagttacaaaatacagtgtattttattggaatcttcattgcattctccgattttattagtgctcaacctttatgacagtgcttgtgaaacaaatataaaattgcaatgcatgatgcagactaaccaaaaagttgtgtgtatcggtttctctcctttatagcaattttccatggtctggacaccctaaccgtgatgggcattgcgtttgcagcctttgtgatcggagcactcctgacgggggccttgtggtacatctattctcacacaggttagtgtgactgttgagtaagagtt

SEQ ID NO: 39566 - DNA, 467 bp, Homo sapiens
ggcgagtggagtgtccgctgtgcccgggcctgcacccatgagcgtcccggccttcatcgacatcagtgaagaagatcaggttagaaaatggatttctgactggaatctcaccactgaaaaaaaagcacacccttttaagactactttatgaggcacttgtggattgtaagaagaggtattcaaaatgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaaca

SEQ ID NO: 39567 - DNA, 118 bp, Homo sapiens
tgcagtggttcacgcctgtaatcctagcactttgggaggccgaggtcggtggatcacgaggtcaggagttcgagaccagcgtggccagcatggtgaaaccctgtctcaactaaaatac

SEQ ID NO: 39568 - DNA, 408 bp, Homo sapiens
ggcagtgagttcgacacaccatgccgactgtcagcgtgaagcgtgatctgctcttccaagccctgggccgcacctacactgacgaagaatttgatgaactatgttttgaatttggtctggagcttgatgaaattgtgcagtttgtccactgatcaccagcatcgctgtgtttggcccataaagaaggctgcctcctatcaggaaaaaactggagcaatacaatgcaccgtggaaggagagagtggaactaattgaaaaagtcataactatacaaaccagaaaatcactggaactgaagaaaaagacatctgagaaggaaataataagtaaagaacaaggtaatgtaaaggcagcaggagcctctgatgttgttctttacaaaattgacgtccctgccaatagatatga

SEQ ID NO: 39569 - DNA, 221 bp, Homo sapiens
  misc_feature 147, 206: n = A,T,C or G
tcatttacataaatattatactagcatttaccatctcacttctaggaatactagtatatcgctcacacctcatatcctccctactatgcctagaaggaataatacgtatcgctgttcattatagctactctgataaccctcaacacncactccctcttagccaatattgggcctattgccatactagtctttgccgcctgggaagnggcgggggggcctag

SEQ ID NO: 39570 - DNA, 436 bp, Homo sapiens
  misc_feature 406: n = A,T,C or G
catttttaaatattttgtgtaaactcataatctatggatggattagaaggcagcctgagtttaattatttgttcattcacccatttatttgttcatttgttcatgcactcagaaagcatttcttgcatacttgttagagatcatgcaccatttcagattctgaggttacaaagaaaaaggctactatggccttcaaggagcttactgtttggagcaaagtttctggaggcatgatctagagtcctagggatctttgagaccctttaaagaatctgcaaggtcaaaactattttcataggaatatcaagtcattgtttgccttttctttttcactctcattctctcacaagtgtacagtagagttttcgagaggctgtaagacgtagggtatcataaaaagaaggcngaagcagatatgagaatccagcttttctct

SEQ ID NO: 39571 - DNA, 364 bp, Homo sapiens
agaatcattaccttttaccgcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaacta

SEQ ID NO: 39572 - DNA, 437 bp, Homo sapiens
aggagaaatacttttccttgtttaactgcaaaacaagatgttaaggtatgcttcaaaaattttgtaaattgtttattttaaacttatctgtttgtaaattgtaactgattaagaattgtgatagttcagcttgaatgtctcttagagggcgggcttttgttgatgagggaggggaaacttttttttttctatagacttttttcagataacatcttctgagtcataaccagcctggcagtatgatggcctagatgcagagaaaacagctccttggggaattgataagtaaaggcagaaaagattatatgtcatacctccattggggaataagcataaccctgagattcttactactgatgagaacattatctgcatatgccaaaaaaattttaagcaaatgaaagctaccaatttaaagttacggaatctaccatttt

SEQ ID NO: 39573 - DNA, 453 bp, Homo sapiens
  misc_feature 38, 440: n = A,T,C or G
caattacatgtatattagacctttgattttgtcccagnagtccctgaggctatatttatttttcttccatttttttatgcatttttcagattgcatagtctctgttgatttgacttcaccactgacaatctactgttaaactccctgagggaagttttcagctctagaatttgcatttggttcccagtatagttctcagttctctattagattctctgctcactcattaagagtatattttcctttaattctttgaatgtatttttctttgcctctttgaaatatttataatagctgttttacagtcttcatctgctaagtccaacatttgaaccatcttgggttcagtttctatttactaccttttttcctgactatggatcacatttacatgtttctttgtatgagtaggggggttttgattgaacaccagaccttgnggataacacattg

SEQ ID NO: 39574 - DNA, 313 bp, Homo sapiens
  misc_feature 11: n = A,T,C or G
gaaccaacagnagaaatgaagcttatgtgccacctgagggagagtcttattaccttataaacccagtgggaaagggagaaagccaggcgtagacctcatcaccatcccaaagcagagcccattctcaagctttctgtaaggcagggcagcaggaaatttaatcggagttatcgagaaccagccatgtgtaactttttgtgcaggtgggaaaacagaaaagcataagggaaagaaactagtttttgttctaaaaaattatctaatcttcatagctacccactgaagtagatattattatccctatttagcagac

SEQ ID NO: 39575 - DNA, 111 bp, Homo sapiens
cgggcaggctgaggcaggagtaattcgcttgaacccgggaggtgaaggttgcagtgagccgagatcgcaccactgcactccaagttgggcaacagagtgaggctccatctc

SEQ ID NO: 39576 - DNA, 345 bp, Homo sapiens
gatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcggcggggggcctagccctactagtctcaatctccaacacatatggcctagactacgtacataacctaaacctactccaatgctaaaactaatcggcccaacaattatattactaccactgacatgactttcc

SEQ ID NO: 39577 - DNA, 127 bp, Homo sapiens
catgaggcaggtgtttgcaaagccagctctcggttccgatggggtattgctgacctacttttctaggggaaatgctcttaaacactgtaattatgcatttctaatgaaataaaatgtatttatgacc

SEQ ID NO: 39578 - DNA, 472 bp, Homo sapiens
  misc_feature 34: n = A,T,C or G
ggtaggagcctctctccctactgctgctacacangtaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttata

SEQ ID NO: 39579 - DNA, 157 bp, Homo sapiens
  misc_feature 7: n = A,T,C or G
catgaantgctaagcaaggttcctcatgctcaaaatcttgggagcgatgttgcccctggatgtgttatgacaagacttgctgcggtcctgctatcacctggggtgaggttaccccagcaggcctgatgtcataatagctatctgaatattaaaaagt

SEQ ID NO: 39580 - DNA, 272 bp, Homo sapiens
  misc_feature 6: n = A,T,C or G
tgcggnggctcacgcctgtaatcccagcactttggggggctgaggcgggtggatcacgaggtcaggagattgagaccatcctggctaacacggtgaaaccccacctctactagaaatacaaaaacttagctgggcgtggtggcgggcgcctgtagtcccagctactggggaggctgaggcaggagaatggcgtgaacccaggaggcggagctttgcagtgagcccagatcgcgccactgcactccagcctgggtgacagtgagactccgtct

SEQ ID NO: 39581 - DNA, 477 bp, Homo sapiens
tatggccggggtccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttct

SEQ ID NO: 39582 - DNA, 305 bp, Homo sapiens
  misc_feature 12, 240: n = A,T,C or G
attattactatnatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgnattttctgattttataccaactgtgtggactaagatgcattaaaataaacatcagagtaactcga

SEQ ID NO: 39583 - DNA, 456 bp, Homo sapiens
ctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggccccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattc

SEQ ID NO: 39584 - DNA, 360 bp, Homo sapiens
caatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcaccttggcttcgaagccgccgcctgatactggcattttgtagatgtgggtttgactattttctgtatgtctccatctattgatgagggtctca

SEQ ID NO: 39585 - DNA, 483 bp, Homo sapiens
  misc_feature 7: n = A,T,C or G
gagaagnttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttaccgtagaccagaaccaatttagaagaatacttgaagc

SEQ ID NO: 39586 - DNA, 154 bp, Homo sapiens
aaaaaattagctaggcatggtggtgcgcgcctgtagtcccagctactcgggatgctgaggcaggagaatcgcttgaacccaggaggtggaggttgcagtgagccgagattgtgccactggactctagcctggtgacagagcgagattccatcgc

SEQ ID NO: 39587 - DNA, 215 bp, Homo sapiens
cattgccgggctggggcagagaaaatacaagtatgagcttagaacatcttctgccagcaaagtaaaaaagtgccgacagagtaatggagacaaatcaaagagacataaagtcagcttggaatgtctactactggcctaatcttggggaattggagcatcagaatcatgagctttccttctcccttatttattggttttatttctccatgtggaac

SEQ ID NO: 39588 - DNA, 476 bp, Homo sapiens
gaagaagatccatgagaatgagaagcgcctggaggcaggagaccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcacttggcatcgtctccgcacctgtgcctaagaagctgctcatgatggctggattcgatgactgctacacctcagcccggggctgcactgccaccctgggcaactttcgccaaggccacctttgatgccatttctaagacctacagctacctgacccccgacctttggaaggagactgtattcaccaagtctccctatcaggagttcactgaccacctcgtcaagacccacaccagagtctccgtgcagcggactcaggctccagctgtggcta

SEQ ID NO: 39589 - DNA, 466 bp, Homo sapiens
  misc_feature 29, 33: n = A,T,C or G
gagaatacagggaaagggttacccaaagnagtntaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattaagagtatccaaggttgacagtgaagggactgcatttgggagctatctgaagacaaaaacagctttttgaagtttctttcatacgtcaccttacatggcctctcgcattctctgtggagaagtttgtgt

SEQ ID NO: 39590 - DNA, 481 bp, Homo sapiens
tgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatat

SEQ ID NO: 39591 - DNA, 484 bp, Homo sapiens
  misc_feature 34, 478, 481: n = A,T,C or G
atacatattgatatatattctaaagagtacagtntacaagcagaatcctatatttcacaaatgcataaaagatgacagtaagacagaaagtgagaaatgccctttgagcatggggaaaggtgattttagttgatgaccacttgaagggtgtgattttgcgatgactgttataggtcagggcttataggccagcatccaaggggctcctcattcccggcaaagttatttcagctgcagcttggatttgctgctgaaggtaggcagtgatgtttgggatccaaatatccaggaaagataaagagaggaaaggcctgtctttccactaagtcaaaacaataaaatttaaaaactgaagtcttcagctatcttttctcttctcattttctataaaaggaagcatatgaagatattgaagtaaggccaaaaaggctcaaagtcagccaacatcaagacttgaaataagagccagagactgtgntgnttt

SEQ ID NO: 39592 - DNA, 211 bp, Homo sapiens
  misc_feature 7: n = A,T,C or G
atgaganagagatggagaagagaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacg

SEQ ID NO: 39593 - DNA, 478 bp, Homo sapiens
  misc_feature 18, 237: n = A,T,C or G
tatggccgggcatgaaangattttggattttatcaaaagctttgaagaagcattttgttgaattaagttgatacttattttttacttattactaacaagcataaatacctgaaactgtagaataaaacacttctacaatatatcacttctattgaaaaaaggaatttcagtaataatttggacaaatgatagtgaagggagtaggaggggatatttctaaaaaaattctgatacatnacaacaagactttataagtgtaaaattagatgctgcttattatgtacatggagaaaggcattttgtagtgtagtctgagcaataaccttttgaaatgaaacatattaatcatgcttgctcaacatatgtaagaaatctttgtaaacacatatgcacgtgttatcatttcagaagctcaggctaaatagttaaatagatccattctccacatcctagataaatttctgggtaaataaactat

SEQ ID NO: 39594 - DNA, 405 bp, Homo sapiens
attgtaacctggaatcttctctctcattataccttataacttgttaaagctgttgatttctatgttaatttttatatcctgcaactttattaaattgtttgtcctagttttctctgattctcttatgtaattgagttagataccatatcaccacctaatagagatagttcacctccccttttccaaatagtatgcttctaattacatttccctggtgtgttcgcaaatacttccaattctgtgttaaatagtagtggagataatgggcatttttgttttgtttctgaacttgtgtctctagtgtttctttgttaaatgcgatgtacataattttgtattgatttacagatgtagaaaacaatatacatatttataatagcatataatacatatattatgtaatac

SEQ ID NO: 39595 - DNA, 467 bp, Homo sapiens
  misc_feature 407, 426: n = A,T,C or G
acgaggcggtgtgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtccttgggggaccagcagcactgtgacgaggctaaggccgtggatatcccccacatggacatcgaggcgctgaaaaaactcaacaagaataaaaaactggtcaagaagctggccaagaagtatgatgcgttttttggcctcagagtctctgatcaagcagattccacgaatcctcggcccaggtttaaataaggcagggaaagttccctttccctgctcacacacaacgaaaacatggnggccaaagtggatgagggngaagtccacaatcaagttccaaatgaagaaggtgttatgtc

SEQ ID NO: 39596 - DNA, 120 bp, Homo sapiens
aagtccgagcagtacaacacactgggagggaatgccctctccttttaaaggcaggaatttttatttattacctgtgttcagtatgtaaacgtgaaataaaccagtggattcttaaatggg

SEQ ID NO: 39597 - DNA, 427 bp, Homo sapiens
  misc_feature 12, 49: n = A,T,C or G
tatggccgggcnaggccaagaaaatttaaatctaaagtgagcaattaanaattaactaccaataatgaaaattagagcagaaatcaatgaaaatgaaaaccagtatagaaaatcagtagagaaaatcctggatggatgaataggtggaattcagtaaatttttagggcagtgaaactatctaaatgatactgtaatggtgaattagtgacattatgcatttttaagtacccacagaacttgatatctcaatgattacaccctaatgtaaaccagggactttagttgataataaaatatcaatattgtttcattaattgtaaaaattgtaccacaccaattttaaataggggtagtagccttggagggtagtggtatgtacagaggcagtgtacttgctgcttaagttttctttaaacctaaaacact

SEQ ID NO: 39598 - DNA, 245 bp, Homo sapiens
ggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttat

SEQ ID NO: 39599 - DNA, 482 bp, Homo sapiens
  misc_feature 34: n = A,T,C or G
ctaagaagtaaacttacatacctttatagcatangagatgattttctttaacaagacattaaaaggaagtataaaggaaaataggctggaattagaccacattaaaaacttaaagttctgtaaaacaaagggtgacatgactaaatataaaagacaagtgacagattgaaagaacatttatgacatatgtacttgtcaaaggaggactatccataatctataaataactcagacaaatcaataaggaaaacatatcaaaaacattggcaaagactaggaaaaaatctagaagaaacatgaattaccagtaaacatgggaaaagatgctcaacctcaggaataaacaaggaaacccaaaataaagtgcaacctccatttaacttccattagattggcaaacatttcacaaatttcacaacctccttacgcaattcactgaggacgcaacatctcttgtataatattcctgacaaaaatgcaca

SEQ ID NO: 39600 - DNA, 490 bp, Homo sapiens
atatttcaaatatttgtagatttatagcaaatatagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgt

SEQ ID NO: 39601 - DNA, 463 bp, Homo sapiens
  misc_feature 2, 34, 57: n = A,T,C or G
gnagcccgtgtgtagctcagcagatacgtttttntgtgtatatagctgagtgtgtgngggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatag

SEQ ID NO: 39602 - DNA, 491 bp, Homo sapiens
gattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttacgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaat

SEQ ID NO: 39603 - DNA, 151 bp, Homo sapiens
  misc_feature 151: n = A,T,C or G
cttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtn

SEQ ID NO: 39604 - DNA, 275 bp, Homo sapiens
gagggccgggcacaatggctcatgcctgtaattccagctctttgggaggcagattgcttgactccaggagctaagaccagcctgcacaacatggggaaacctgtctccacaaaaaatacaaaaattagctaggtgtggtggcacatgcctgtagccctcagcttctcgggtgggtgaagtgggaggatcaactgagcctgggaggttgaggctacagtgagctgcaaccatgccactgcacttctagcctgggcaacagagtgagaccttgcctc

SEQ ID NO: 39605 - DNA, 465 bp, Homo sapiens
  misc_feature 31: n = A,T,C or G
ggtaacatagaaagttaggtcatagacctgngccatggacctgtgtaagtatttaagacatttggacatattttgtatctgtaacttcccttccctttttaaaaagttctctaaactagaaatggtgtagatatggaatcaactgtgaaactatccttctctggcagctccaaaatcctttacattttttcctggctgggtgacacgattttaaccctaactgaatgggccaatctttggccttttctacaagttctcaaattcaagggcagagagtctagtggacctggatacttgtaccgggttaaatggacttatcagtgaggtattatctagctttaaccttcacaagatggacacatggcttaaaaagcctcctctgaagaaaccatgggttaaagatagactaataacacaggccacccaaaaaaccaaactgacaaaaacagcaaaggtagcacttct

SEQ ID NO: 39606 - DNA, 478 bp, Homo sapiens
  misc_feature 24: n = A,T,C or G
tatggccgggagtggggatctagnaggaggatttgcaggaagagctcgtggaagaggtggtggccccagtcaaaactggaaccagggatatagtaactattggaatcaaggctatggcaactatggatataacagccaaggttaccggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgaccgttgggtccctctgaagtttaattctgagttctcattaaaagaaatttgctttcat

SEQ ID NO: 39607 - DNA, 467 bp, Homo sapiens
catgatgcaattacctgacaccaggcccttcctccaacatgggggattacaattccacatgagatttgggtggggacacaaattcaaaccatatcagaatgttagtgactaaagtaaatgttcttgattaactctttaatgtgtatattgagtgcaagccatatgcaggggctattctaggtacttggtggtttactcaagaaaaagggggcaaaaaaatgaagaaggtggccaggcatggtggcttgcgcctgtggtcccaacactttgggagactgagacgtgagaattgcttgagcccaggagtttgagatcagcctggtaacatggcgaatccctgtctctacaaaaaaatgcaaacaaacaaacaaattaatcgggcatggtgtcacattgtctgtagtcccagctacaggttgaggtgggaaagatgccttgagcctagggaaggttgaggctgcagtcag

SEQ ID NO: 39608 - DNA, 218 bp, Homo sapiens
gaggcatctgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagt

SEQ ID NO: 39609 - DNA, 190 bp, Homo sapiens
gacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgcg

SEQ ID NO: 39610 - DNA, 441 bp, Homo sapiens
  misc_feature 53, 400: n = A,T,C or G
gtttgattccttgggaatggccttaaaaataaatgtaataaagtcagagtggnggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaatttttttttctgctggnggatttacatattaaattttttctgctgggggataaacctt

SEQ ID NO: 39611 - DNA, 479 bp, Homo sapiens
  misc_feature 34, 436: n = A,T,C or G
gacaccgcgctgcgcagttttgttctgctccatntgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggngggcacaactgtgtgctctgctttccagcatcttggttgggtt

SEQ ID NO: 39612 - DNA, 497 bp, Homo sapiens
  misc_feature 3, 9, 29, 54: n = A,T,C or G
aantcggcntttatggccgagagcttagngcctggtggctaggtcggttctctnctttccgtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattgggagattacaatgattaaatcaataaata

SEQ ID NO: 39613 - DNA, 382 bp, Homo sapiens
  misc_feature 34, 35, 276, 313, 338, 344, 346: n = A,T,C or G
ggcagaacctggccttccatctctctcagacacnnagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagtagctccacctactgtaaccaaatgatgaggcgccggaatatgacacaggggcggngcaaaccagtgaacacctttgtgcacgagcccctggnagatgtccagaatgtctgtttccangaaaangncacctgcaagaacggggcagggcaactgctacaaga

SEQ ID NO: 39614 - DNA, 439 bp, Homo sapiens
  misc_feature 8: n = A,T,C or G
ggagcacngactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgactt

SEQ ID NO: 39615 - DNA, 471 bp, Homo sapiens
gtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagcctaatttccagtttaagtaattgcctacaataaaaagaaattttgcctgccattttcagaatcatcttttgaagctttctgttgatgttaactgagctgctagagatattcttatttcactaaatgtaaaatttggagtaaat

SEQ ID NO: 39616 - DNA, 214 bp, Homo sapiens
  misc_feature 34: n = A,T,C or G
gacacaggctgttgagaattctttgccacttttnccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgt

SEQ ID NO: 39617 - DNA, 491 bp, Homo sapiens
  misc_feature 8: n = A,T,C or G
gaaaagcnatttgctgtgtgatagaaaagtttttcttaaagtattttttaacatattaccacgaagctgaacttgactattacaatatgagttgtagaatattagcactgtgtaaagttccatagcaaaatgtgattgtgttacattttttggcccacttacagttttatgaaaatcgcgggatgtgtttgcacctgttttgttttttaaattcatttttcatttaactttgacccgtcagatgtctgaatttgtgacactgcttgtgatctcttagtgcgtatctcccttttctttcttgtgaaacaggtatagtactcttaagatttagttaggctgacagactacacttttaacttttcctattcaagacaggctggaatgcagtggcttgatcatggctcactgcagcctcgacttcctggtctcaatcgatccttctgcctcaacctccctagtggatgggaccacaggcacatgacaccttggct

SEQ ID NO: 39618 - DNA, 285 bp, Homo sapiens
atactaattgttgaatgaactgaagctattattgtttgcttttccaggtagctttccttactgaatacatgtggatttaggggagggtgatcaagtgctggagcaaacattttcctgattgtactttcagagaaaaatctgtgagcaaataaataatgatataagttgcaaatctcttaatgaacctagagattcttgccacaaatttcccaatgaatacatatcttttcaatctaacagttttgattttctaagactttaaatttgattttcaatttatacttt

SEQ ID NO: 39619 - DNA, 475 bp, Homo sapiens
  misc_feature 443: n = A,T,C or G
tatggccgggagcgttacgtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtanggatgaaacaatttggagaagatagaagtttg

SEQ ID NO: 39620 - DNA, 413 bp, Homo sapiens
  misc_feature 8: n = A,T,C or G
atatttanttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataat

SEQ ID NO: 39621 - DNA, 193 bp, Homo sapiens
  misc_feature 3, 9, 29: n = A,T,C or G
aanccggcnttttatggccggatttaatnctgcaaaaagaaaagtgagagtgagagcagaggtgacctgggaacgcctggctgttctgcaggaatgttcccctccctggagctggaatctgggcaaagataaacgcttgcagcatgaggaaagcattaagcattaacttggccaaacagcccaaggttattct

SEQ ID NO: 39622 - DNA, 119 bp, Homo sapiens
ggaactcaggaagttcaaggctgcagtgagccatgatcatgccactacactccagcctaggcacacagcaagaccttgactttaaaaaactaataataataaataaatatttctttgtt

SEQ ID NO: 39623 - DNA, 396 bp, Homo sapiens
  misc_feature 7, 32, 33: n = A,T,C or G
ggagttnggtttggagcaaaactgaggtagtnntaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacgttcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgc

SEQ ID NO: 39624 - DNA, 495 bp, Homo sapiens
aaagatgaaccagccagcctagtctctggatgcataagctccaagtgtggaggagacccggagagaaaagcagactgttctttgtgtttacctgtaagcacaggccgcaacctgccatgctgtttttaaatgcccaagagctggtgacaagagggtttccctttgccatctggacctgattgccttagaggcttggggaggaggggagagagaggaagcttcaagagtgtctttgtggttgctggttgaccagtataaacggtatttacacatttagagtggcagactcaccagtacgtgagagaattgtcgatgatgcaggcaaccttacatgaaatgtacccctccagcattcaacgcagcagaatcacctagtagaagttattctctttctaatttgttttcagttgttttaatttcatcgagtctcaagttggtgctagcctaggtcattaacacctcccggacacttgctaacccttgcctttttttttt

SEQ ID NO: 39625 - DNA, 242 bp, Homo sapiens
  misc_feature 18, 19: n = A,T,C or G
tatggccgggagacagcnngatagaatgaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaat

SEQ ID NO: 39626 - DNA, 483 bp, Homo sapiens
  misc_feature 17, 41: n = A,T,C or G
tatggccgggggtagtnttgttgttttcagcctgctgctgntgttgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagat

SEQ ID NO: 39627 - DNA, 346 bp, Homo sapiens
agagaacgttcttattctctacaggtgattgttatccagataaggaccttgggatcttttaaaatcagaggctaataattcttttttatctttttaaaaaaattgagatgcagtcttgctatgttggccaggctggtctcgaactcctgggttcaaaccatcctcccacctcagcctcccagtagctaggattataggtgtgtgtcactatgcctggtttagggcctagtatttcttaggagaaagtagaaataagggtttcattggggctatatcttaaaaaataaaaatgaaagtaatggtttatatttaaattataattgcagctttgtactgatttttgaga

SEQ ID NO: 39628 - DNA, 126 bp, Homo sapiens
gtcttttggagaaccagggctcttctcaggggctctagggactgccaggctgtttcagccaggaaggccaaaatcaagagtgagatgtagaaagttgtaaaatagaaaaagtggggttggtgaatc

SEQ ID NO: 39629 - DNA, 473 bp, Homo sapiens
gagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcctattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccatt

SEQ ID NO: 39630 - DNA, 469 bp, Homo sapiens
ggagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttattaat

SEQ ID NO: 39631 - DNA, 336 bp, Homo sapiens
  misc_feature 36, 129, 244: n = A,T,C or G
atatcatgtgatgctcagttctattttgatttattnattagtattcacttttacctttaaagtttacttgtagcaaatatgtttacattgatatgttttgacaatgaaatttacatatcaagtactgcnaataaaaggtggcgctatgatatatgcttaggaggacagttttaatgattgtacttgcatgaacacaatcatatgatggtaaagcagaaacttaagaaaaaattggttatgtgtnatattcaattagcttaaataagttgctttgttatattttatttgaattgaactacgctaggcctaaatgccaataaaatatacttttcactg

SEQ ID NO: 39632 - DNA, 401 bp, Homo sapiens
gagagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctg

SEQ ID NO: 39633 - DNA, 467 bp, Homo sapiens
atacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccac

SEQ ID NO: 39634 - DNA, 340 bp, Homo sapiens
aggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagattgaaacaagatagaaaatgaaaatattgtcaagagtttcagatagaaaatgaaaaacaagctaagacaagtattggagaagtttagaagatagaaaaatataaatccg

SEQ ID NO: 39635 - DNA, 467 bp, Homo sapiens
atgaaagattagagatgtatgcttcaggtcaggatggagtaacagaggcttgatttattatcctgactgaacaaacaaaaaatggacaaactatatgaaataatggcttccaagccaatgggcatcaggcagtgaaagacaacgatccctgaaaagtaagaaacaaacatggtgacagtacagttgtcccagtttaccgcctagacaaagtttccaggtgtaaggcagggagaggaaactcacgcagaatctgggagactctgagttgggcatttggagttgaaactccaggggaccacaatgacttgcaggatggagagaaggctgaacagagagagagctgttggagatctgcagaggatccgccatacgtattcaactgagcgttgggtaggaggacattagggacattgaaggccagggaaagaaccaaatgaaaagattggaaagagaggctaacccagtgc

SEQ ID NO: 39636 - DNA, 468 bp, Homo sapiens
cacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgcttgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctccgttttgatgatggtgctggaggtgacaatgaagtgcagagaacaatgttggaactgatcaatc

SEQ ID NO: 39637 - DNA, 228 bp, Homo sapiens
  misc_feature 2, 5: n = A,T,C or G
cnttnctggccgggaacgtaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcga

SEQ ID NO: 39638 - DNA, 461 bp, Homo sapiens
gtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaat

SEQ ID NO: 39639 - DNA, 325 bp, Homo sapiens
  misc_feature 5: n = A,T,C or G
taacnagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagc

SEQ ID NO: 39640 - DNA, 274 bp, Homo sapiens
agaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgggt

SEQ ID NO: 39641 - DNA, 463 bp, Homo sapiens
  misc_feature 134, 461: n = A,T,C or G
tcacctgtgaagtggatgcccttaaaggaaccaatgagtccctggaacgccagatgcgtgaaatggaagagaactttgccgttgaagctgctaactaccaagacactattggccgcctgcaggatgagattcangaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccngc

SEQ ID NO: 39642 - DNA, 189 bp, Homo sapiens
  misc_feature 3, 148: n = A,T,C or G
atnattcctgtggttttccgcttttttttaagcatcatctttctctctccttcagttaaacattctccatcagaatacagacgtgtgtattagctcccaaactaaaaccacaaacttctcttgattattattattattattttttggngggtcttcctccagcctgggcgacagagtgagcctctgtcc

SEQ ID NO: 39643 - DNA, 212 bp, Homo sapiens
cgaattttgaattgagtaaagtgcaatttccttggatagctaaatattctttgtaagatagagattgttgaaaattctatttttgtttttctagtcctttcaccccaggactctaaattattggggtaaaaaacagccttgcaagaaaaaggggagctattttttgctttttatggttttttattggtgtaaaactttgtattccccttttt

SEQ ID NO: 39644 - DNA, 396 bp, Homo sapiens
  misc_feature 34: n = A,T,C or G
ggggcgaagctaccatttgtgggatataaacagnggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagga

SEQ ID NO: 39645 - DNA, 467 bp, Homo sapiens
  misc_feature 309: n = A,T,C or G
ggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctnattctgtttgtaaaaccagccagtaatttctgtgcaacccttactatgtgcaatatttttaaatcctgagaaatgtgtgcttttgttttcggatagacttatttctttagttctgcacttttccacattatactccatatgagtattaatcctatgga

SEQ ID NO: 39646 - DNA, 465 bp, Homo sapiens
ggcacctgggcagctctgcaacatcctcccaggtggtcccactgaagcacctctatttaaatccctctgttccgaataaggaggctgtgtaaatggacctgcagatctttctgacatgtaggaatggactgggagagatgcagacttctgcagggggagagagtttctgggcattgagcagcaacattgcctctgtccttcattttagtttacaactttatatcttcccttaatgaggttttccgcagctgtgaaagaaataaaataaattgaggtattgagagaacacatagaaagtggagaggctatttttctgttacctgtttttgtcttccttaattgtctagtttagcaccacttgaaaaaattgcgttacatttaagtttgatgagctccttgtgaacatgtgaatcagtagtttctcgaggtgctgctgggttcggtgacacaatacagaacacaaag

SEQ ID NO: 39647 - DNA, 466 bp, Homo sapiens
  misc_feature 374: n = A,T,C or G
ggcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaacctcgaagagcagtttgtgaaaggacacggtccagggggccaggcaaccaacaaaaccagcaactgcgtggngctgaagcacatcccctcaggcatcgttgtaaagtgccatcagacaagatcagttgatcagaacagaaagctagctcggaaaatcctacaag

SEQ ID NO: 39648 - DNA, 466 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaat

SEQ ID NO: 39649 - DNA, 343 bp, Homo sapiens
  misc_feature 223, 238, 309, 312: n = A,T,C or G
gaaaggagtacagcgtgaaattgtagatttaagattgttaaaatcatgacaattctaacttgtctattctaacctattgtgtacaatctgattttttaaaattgtaaacatgtatgatcttggtttcatgtgtttttgaaagtgttattgcttaaaaaatgaaaaaagcatatctgctaaagagctgtcagttttcattactgactctgtaaaatacactgtnctttgtgtactgtgngttattttgccagctgctgcattagccttcaaaagtatttggaaacttaagatgaactacatttcttgcanagnacatgtcctttctgtggtattttgtcctgta

SEQ ID NO: 39650 - DNA, 415 bp, Homo sapiens
  misc_feature 413: n = A,T,C or G
ggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtaggggatttactggcatggtatcattcctgganga

SEQ ID NO: 39651 - DNA, 464 bp, Homo sapiens
  misc_feature 15: n = A,T,C or G
atattctcagaagtngaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagt

SEQ ID NO: 39652 - DNA, 465 bp, Homo sapiens
ggtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtgg

SEQ ID NO: 39653 - DNA, 466 bp, Homo sapiens
ggaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatt

SEQ ID NO: 39654 - DNA, 214 bp, Homo sapiens
  misc_feature 16, 30, 31, 32, 36, 37, 40, 47, 49, 55, 59, 60, 93: n = A,T,C or G
aaaataaaagcttatngtttgaacttaaannntatnngcngaagaananactttnatgnnacagaactttttttgaacattttaaacagctanattgagatacaattcatataccatacaattcacccactgaaagtgcacaattccatggctttagtatattcacagagtttgcatccatcaccataatcaatttttgaacattttcattact

SEQ ID NO: 39655 - DNA, 213 bp, Homo sapiens
  misc_feature 41: n = A,T,C or G
atccatgtcctctgagtcattacttttctctatttgctgtnggtcatctttcatgttacagtctttttttgaacattttaaacagctttattgagatacaattcatataccatacaattcacccactgaaagtgcacaattccatggctttagtatattcacagagtttgcatccatcaccatacatcaatttttgaacattttcattactcc

SEQ ID NO: 39656 - DNA, 211 bp, Homo sapiens
  misc_feature 28, 40, 41, 208, 209, 210: n = A,T,C or G
cagggagctgaagtgaagggcgtgtgcncacggaagctgnnatgtatgccctgcgagaacggcgagtccatgtcactcaggaaggactttgagatggcagtagccaaggtcatgcagaaggacagtgagaaaaacatgtccatcaagaaattatggaagtgagtggacagcctttgtgtgtatctctccaataaagctctgtgggccnnnc

SEQ ID NO: 39657 - DNA, 468 bp, Homo sapiens
gggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagca

SEQ ID NO: 39658 - DNA, 473 bp, Homo sapiens
  misc_feature 265, 283, 306, 431: n = A,T,C or G
ggggggtatatatggggcattcaaaatgcatgaaactaggaattcgtttgtcatctttaggaaatttcagaagtagtttctgaccattttatgtgggtcctttattttcaagtttagacattgggattttatcctgagaataatggggaaccattgaaggttttctacaggggacaaggatagcatgttggaatgactaaccagatagaaatatgcacaatttcttgaaaatagggagaacgagaaaggaagaaagcagaacagnggttcttgactttaatgngccacctaagggccaggtgcagngggtcacacccgtaatcccagcactttgggaggccgaggtgggtggattgcttgagtccaggtgtttgagacaaggctgagcaacatggtaaaactccatgtctacaaaaaaatacaaaagtggngggggtgtgccttgtaatcccgctgctcgggatgctgaagtg

SEQ ID NO: 39659 - DNA, 180 bp, Homo sapiens
  misc_feature 55, 93, 109, 113, 136, 142: n = A,T,C or G
aacaatggagtttggaagtttgtatggcctataatgttctaagttccagcaatgnaaaaggatctgtaacaatctgaataggatgtggacacntatagcagagagactntgtnaattatcttgcagaacaaaatanaagggnctaaatcacgttaacctcaaaccttgagactagccttg

SEQ ID NO: 39660 - DNA, 174 bp, Homo sapiens
  misc_feature 2, 10, 34, 40, 100, 130: n = A,T,C or G
gncctagctngtgactgaaattttagaaaaaggnagtacntctatagccgaattgataaggttattactgtgttttgcacaaagtgtattagcaaaagtntttgctggaatcatgtggtagatggcatgncccacttcctacacctgctttgtcaagatacagctgggttccct

SEQ ID NO: 39661 - DNA, 482 bp, Homo sapiens
  misc_feature 10: n = A,T,C or G
atgttcaagnaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaag

SEQ ID NO: 39662 - DNA, 400 bp, Homo sapiens
  misc_feature 396: n = A,T,C or G
caggaacctcctttgagctagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttaccgtagtgctgacaggacccactctttcattggaaggtgatgaaaatcaaataaagaatctcttcncctg

SEQ ID NO: 39663 - DNA, 465 bp, Homo sapiens
ggtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctca

SEQ ID NO: 39664 - DNA, 463 bp, Homo sapiens
cagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatgcttacagtcagccactgcttttgattagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgcccggatgttgccagatgc

SEQ ID NO: 39665 - DNA, 262 bp, Homo sapiens
atccggggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttcctt

SEQ ID NO: 39666 - DNA, 471 bp, Homo sapiens
  misc_feature 25, 43, 180, 181, 187, 232, 301, 313, 326, 375, 427, 450: n = A,T,C or G
ggatttggatacaattttgtgtatncaaaaaggaagcctgcgnaaaataattctgggaaacatgagttgaaatgcagagtaaactcagtactgcgatccatagcaatattttgcatattattattttttcttttaaatttttttcttgatcagatttatcatattcattgaatattattnnattgcncttggctcctggcttccccccatcctgtgctctgaagtcagagtnttatttgtggctctatgaaatgtccattgcttggatacggtataaatttaattatcttttgtagttttnctcacagtatanactgaaaaggtgntggttaattttgcaataacagaccactgcatatttcacaattaagtgtnttcaacagtgttaaggcaagatttacagtaacacttttaaagtgccagatgnacattgacagaaattttcttagncaatcctacatcgatcatgat

SEQ ID NO: 39667 - DNA, 467 bp, Homo sapiens
ggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggt

SEQ ID NO: 39668 - DNA, 463 bp, Homo sapiens
  misc_feature 392, 397, 460: n = A,T,C or G
ggcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaanaattnggattctctcatcaaggctacaattgctgggggggggggtcattccacacatccacaaatctntga

SEQ ID NO: 39669 - DNA, 306 bp, Homo sapiens
atgcaaatgactttattttatttttatttcctgcataccattagaataattttatttcatttcttcaaattaccaagcactgtaatactataaattaatgtaatactgtgtgaattcagactataaaaaacatcattcagaaaactttataatcgtcattgttcaaccaagattttgaatgtaataagatgaatatattccttacaaattacttggaaattcaatgtttgtgcagagttgagacaactttattgtttctatcataaactatttatgtatcttaattattaaaatgatttactttat

SEQ ID NO: 39670 - DNA, 460 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtgattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatt

SEQ ID NO: 39671 - DNA, 468 bp, Homo sapiens
ggtggtgacatggacttgtttatagaagacgggtcagctgtctggctcggtgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagac

SEQ ID NO: 39672 - DNA, 159 bp, Homo sapiens
cgactcttagcggtggatcactcggctcgtgcgtcgatgaagaacgcagctagctgcgagaattaacgtgaattgcaggacacattgatcatcgacacttcgaacgcacttgcggccccgggttcctcccggggctacgcctgtctgagcgtcgcttgc

SEQ ID NO: 39673 - DNA, 465 bp, Homo sapiens
caggcgcagtgtctcacacctgcaatcccggcactttgggaggctgggtgggtcacttgaggccaggggttcgtgaccagcctggccaacatggagaaatgttgtctctactaaaaatacgaaaactagccaggcgcggtggcaggcacctgtaatcccaactactcgggaggctgaggcaagagaatcacttgaacccaggaggtggaggttgcaatgagctgagatcgcgccactgcactccagcctgggtgacagagctagaccctgtctaaaaaaaagaacccaaaaaccacacaaaaagaaaccacactgaatcaatgaaaaaaataaattattccataatgatattcaaaaaagtaaaaactcatttgtgcccattcaaagtagatgtttaaacaagctcttaccttaaaaatcagtaaggcaggaggattaccttatggccaggagttccagaccagc

SEQ ID NO: 39674 - DNA, 155 bp, Homo sapiens
attccaagtaacatttaaagcgggactttaggcgggcatggtggctcacgcctgtaatcccagcactttgggaggccaaggcgggtggatcgcgagatcaggagatcgagagcatcctggctaacactgtgaaaccccgtctctactaaaaatcc

SEQ ID NO: 39675 - DNA, 467 bp, Homo sapiens
  misc_feature 396: n = A,T,C or G
ggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcattggttgctctattggactaccgtgaggatgggngtgaccccatatatgattttctttaaggatgggtttagaaatggaaaaatgttaacaaatgtggcaattat

SEQ ID NO: 39676 - DNA, 388 bp, Homo sapiens
aggaacagtctctttcttccccactgtgttgctgctaccaccaccacccattggtggtctagctgccttgctgtgatgtaacccaccaccgacacaggagggaggcatggctgcaatggtaaacataaaatagacattgtaagaggcacagacccatcatgtgtggttgaaatggacagtttttttttgtaggctcttagtctagggaagctgtgtcattcttgggagtacctttggacaacctaaaggggaaattgaacagcgtgagttggttttaaaactgtgatggcatctcacctccccagcttttttactgcattccagcctggcggcagagcgagaccctgtctcaaaaaaacaaacaaacaaaaaaaacaaacaaacaaac

SEQ ID NO: 39677 - DNA, 466 bp, Homo sapiens
  misc_feature 28, 423: n = A,T,C or G
atggttgtgtttacaaacaactttaatnggtatagttttaattcagcagacctacatacgatattatttcaatgataatggcccctaagattttgtcaaacttttaagataatttcaaaatgaacaaacttataatttcaaagcctttctcttaaaagcttgaggaacccatgttcctcaactgcttatcaattgctagctaaaataaattgcatatgtattttaatattttacaacgatttctatctctaaatgtaactcagcaattcaaacaaataaatggtatcactatgacctgttatctatgtgcaatgcgaattgcaaagattttctattgccagattttcaagacacatttcatgtgttatcttccatctaccaaatattgtagccagtttgagcagtatctttaccttaaactgngtaaaaattatctcaaaataatgcaaagcattatcaagtatgt

SEQ ID NO: 39678 - DNA, 468 bp, Homo sapiens
ggagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaat

SEQ ID NO: 39679 - DNA, 460 bp, Homo sapiens; identical to SEQ ID NO: 36205

SEQ ID NO: 39680 - DNA, 465 bp, Homo sapiens
  misc_feature 14, 409, 410: n = A,T,C or G
gaattaaacaaagncttttgtgtcctgttcagtgaggtaattttaaaaagaagagaaaggaggaccactgaaaagggaagtgtcatgacgctgatatctccccttgccttgttcatgtatgtgactgataaatgccagtggcctgcctttatatttgcaggagctggagtgccttcaggaccatctggatgacttggtggtggagtgtagagatatagttggcaacctcactgagttagaatcagaggtaagtggtatgcagcttactcattggaggagagtggctgccagcatcctggccttttgtgtttgattctactgtttctagactcctgagagtgcagattttctgtcaatcaaaagaaacctgatcaaattttccatgtctgcttataaagaagtatattgnngttgctttgtgagctccttccctcatttctctagaacaacactctatacagccct

SEQ ID NO: 39681 - DNA, 362 bp, Homo sapiens
ggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcgccattgcagatgcttaagtcaactattttaataaattgatgaccagtttac

SEQ ID NO: 39682 - DNA, 468 bp, Homo sapiens
  misc_feature 20: n = A,T,C or G
atagttcaagacaacagagnacaaagctaagatgaggaagttctgtacagtttaggaaatagaggctttcaaagataattcgcagtgatgtgaaactggcctcccaagccctgataagtaagttaaataagagtaggagccaggagggaggttctttactcttgaattaagagaaggggagctggaggtggctcaggtagagtgcgtaggtttgcagaactgggcctgtgtgtgtaaagtgactaaggcaaaggagtggaagtttgagagaagtttaagagaagaaatggacatgattgcctaaatcagccaaacacagggtattgttgtattttctggatttgttttccttatgacctacctttctcagttatttaagaagcaaatctaaaggatatttgttgaaactctctatgcagaaagggtcttgggtgagttgtagtaaccttcagccatgctgattaaaat

SEQ ID NO: 39683 - DNA, 466 bp, Homo sapiens
  misc_feature 360, 363: n = A,T,C or G
atgtttctgtaaattaaaagaagtattttaatacttcaaggtgataatcttatttattgtgtattttcatctctacacatgcatttttcttgagctactcaatgggaatctaaatatagaaggtgagaaatcaagattggcatttacacgaacatggcctgtattttgttgaaatattgtggtgcgtagtttgagttagagttcttttgggtaatacagaattggttgtgaatgaaagcaccctttcagagatcttagaaggactggacttcttataacttgacatcttctaactgcttctcttcttctatctcttctacttattcaacaacaccatagggtttttttcttttttgttgntgntaaaatattcgtgaacataaaaacacactctcacacattgaattagtaagcaaaaatggtttaaagaagatcttaattgccagagtatcaaatgaaatttgtc

SEQ ID NO: 39684 - DNA, 464 bp, Homo sapiens
gtattcttagtagagacacggtttcaccatgttggccaggctggtcttgaactcttaacctcatgatccacctgcctcggcctcccaaagtgttgggattacaggcatgagccaccacacctggcgatgatcaggatttaaggattgtttctgagctcttcctggaccctgtgttttaggtcccccaaagaaggtgtgaacagccttttggaatctgttttactctggcaaaataatctgtgtccatagattgcaggaggatgctgttggtgttataataatgctctcacatttaaaaataagttatcaagtgtatttgaggaagaaaactaagaaaatctggaaaaaaccccaccatcaacaaaagacacgcaaaactctaaaacttgtaataggataaatgatgttcttgtaatgaatgtgtcagcattttaacacatgtgtgctcagtgtgtggtgatgca

SEQ ID NO: 39685 - DNA, 463 bp, Homo sapiens
  misc_feature 455: n = A,T,C or G
ggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtgggagttggtgaatcggntgttcttt

SEQ ID NO: 39686 - DNA, 465 bp, Homo sapiens
gggaattatgagagggagatggaaagttctgcacatttggccagtttttatccctatgaaatctatattccttcttcttttcttataatgttacagtgcttcttagagtgcgccctggttcaggacatagcttagccattaatctagttatttagttttctccctgctctgtggaccaggcgtatgctaacggctccttttactttagattgaataattggtaggtgtttatccaagaggtgttggcatttgctgattttttttaaaaaactgtactcattcatttcgacttattgctattcagaagggtaagaggttagaatcacctgatcgtgttgccaagaatgcaaagcgctatacctcattcctagagggcctgatttattaaagccaggatggaggctgggcaccggtggctcactcctgtaatcccagcactttgggaggctgaggctggaggattgc

SEQ ID NO: 39687 - DNA, 475 bp, Homo sapiens
  misc_feature 13, 440: n = A,T,C or G
agcgggtacaagnatctaccccggaacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggnggaaaacgctaaactggcagattagatttttaaat

SEQ ID NO: 39688 - DNA, 465 bp, Homo sapiens
ggagtcatccaaaggaaagtagattggaagcagaatggtttcagagatcaagaagttatcctgcagcagctttacctggctgtaccaaggcctatggatttttctgatgtgactctttttggggtctcaatgctaattaccataggtgatttgaggagcttccaggataactgaacacaggttcaggggctggccctgcccttcattgcttgtgaagtgcaaggagggaaggaagttcttagcctctggtggggtgaaggggggcagtggtgaagagtgattaaatgaaaggatatggaaaagcacttgtgaaatgatttctggcagttctctgtgagcttttgacttctgagtgcccagagcatcagaggccatggggtgatgctgtgataaatggcaagtgaaagtttagggtcaccaggaattttctgcggtttgcatttttcccataagaagtctgggagt

SEQ ID NO: 39689 - DNA, 335 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttt

SEQ ID NO: 39690 - DNA, 479 bp, Homo sapiens
  misc_feature 356: n = A,T,C or G
gaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggngatatccatccgagtgaccttaaacctgaaagtggtagcaaggacccttcaaaaaatgatacatgcaaaagttgctgggcatattggattttacccatcataggcgctgttctcttaggtttc

SEQ ID NO: 39691 - DNA, 476 bp, Homo sapiens
  misc_feature 16, 446: n = A,T,C or G
atggccgggctctaangaaaaacaatagaatgcagattaaggaccatagtcaaaactaaaataaaatctacaatggagataagtttgcattttttctccccactttgggacacttgggaggagctaagggtcttcagagcctgtagccaacttacctgtggcaagttttctgacaaggatctctgtcagctggcttccttgtaccatttgctcacagaatctctgtctctggtagtaggcaatgtcagtgttcctgagaaggccctcaaaagacttgactgtgttcttcacatgctgggtaaaaaggtagcagacacctctcccttcctgtgtcttctgtcgtaagtgggtcagttcttcagcctgagcctgaattaagggatcatgtatcctaaggtgggaaagaagagtaaaatgtatgagggaatgtagtgaataacaggttntagaaagtttcagaggagagatctcttaga

SEQ ID NO: 39692 - DNA, 160 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcag

SEQ ID NO: 39693 - DNA, 458 bp, Homo sapiens
  misc_feature 11: n = A,T,C or G
atccttaatantttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccgcctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaaca

SEQ ID NO: 39694 - DNA, 500 bp, Homo sapiens
  misc_feature 2, 21, 54, 69, 186: n = A,T,C or G
gnttttccccgggattcggcnttatggccggagactatagaccgatagaacagnaatcaggagcccagnaaatagacccacgtatatatgatcaattgatctttgacaagggtgccaagaatatacaatgggcaaaagatggtttctttaacaaatagtgttgagaaaactggctctccaactgcnaaagaatgaatttggatccatatcttacactgtacacaaaaatcaatgccaagtagattaaaaacttaaatgtaagacttgaaactgtgaaaccactgggagaaagcataagggaaaatcttcatgacattgatcttggcaaggatttcatagatatgacaccaagagcacagcgacaaaagcataaatacgcaaatgggactacatcagactaaacgccttctgtgagcaaaggaaacaacagaatgaaaaaaactaccatagaatgggagaaaacatttgcaaactatgtaatgggagaagggggtaatttt

SEQ ID NO: 39695 - DNA, 468 bp, Homo sapiens
  misc_feature 240, 242, 371, 426: n = A,T,C or G
aagaaaactactgacttttttctagtatattttctcagtaataggattttctatttttctataaaatgaccaatgttatgaagcttcgtaagttttgtcaaagtgatacacacatacagcaaaaaaatcaaatagtacagaagtataaaagcaacaacctctgccttgccccttctccaccttcaggtccccttcccagatacaataatttttagctttttatttttaattattctggtngntacctacataactctgggcaatatggaaaagttattgattttgtatattaatttcataatcagttaccttgatgaattctcttggttctagtagtttttctttagggttttaaagggatacaatcatancccattttgcagttagtaaccattttatctcctcttatttccaacttcgtactgntttctcttgtctaatttggttttaattggggggtacttctag

SEQ ID NO: 39696 - DNA, 244 bp, Homo sapiens
ggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttcc

SEQ ID NO: 39697 - DNA, 158 bp, Homo sapiens
gtatgagatggttaaaaaggcccaagataaaaggtttctttttttttccttttttgtctatgaagttgctgtttattttttttggcctgtttgatgtatgtgtgaaacaatgttgtccaacaataaacaggaattttattttgctgagttgttctaac

SEQ ID NO: 39698 - DNA, 241 bp, Homo sapiens
  misc_feature 240: n = A,T,C or G
aggctgaggcagggggaccatgacgtcaggagttcaagaccagcctgaccaacatggtgaaaccctgtctctactaaaaatacaaaaattagcagggcctggtagcgtgtgcctgtaatcccagctacttgggaggctgagacaggagaatcacttgaacctgggaggcggaggctgcagtgagccgagatcgcgccactgtactccagcctggatggcagagcgagactgtctcaaaang

SEQ ID NO: 39699 - DNA, 405 bp, Homo sapiens
atgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 39700 - DNA, 114 bp, Homo sapiens
  misc_feature 2, 32, 111, 112: n = A,T,C or G
cngcacacagcaacacctttgaccgtgaactngaatggcaactagaggcttactttttgaacttcaggtatgtaactcaaaagtaaataaaaacactattttttcaggtgnngg

SEQ ID NO: 39701 - DNA, 164 bp, Homo sapiens
  misc_feature 7: n = A,T,C or G
gcatgtnaaaagatacacaacttctctaagtctttagtcatctagaaaatgggaacagatatcactgagttttcagtacaagttaaatgagatgacttaggtaaggcacccatatgccaagtaccttggacataataagtgcttagtgaatggaagcgaaacac

SEQ ID NO: 39702 - DNA, 278 bp, Homo sapiens
tcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgatctgcaaagggacgtcagacaagtgcagctgctgtgcctgatgccaggacagctgtgcctctcagatgtaaatagagcaaccctatataaacctg

SEQ ID NO: 39703 - DNA, 156 bp, Homo sapiens
gaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtag

SEQ ID NO: 39704 - DNA, 366 bp, Homo sapiens
  misc_feature 260: n = A,T,C or G
gtttgtctgagatcacgccactgcctccagcctgggcaacagagcccgaccctgtctcaaaataaaagagagatgtaatggacccctttaattaatctataaactcctaattaagaaccctggttaaaattttttaataggagcttgtcttcttcactgttgtatccaaagcctgactgaaatctgtagacacctaagcagtgaaaaatttgatgccttaacctatataatttaaaatcaaaatatttacactataaggngaatttaaggaagatctcatttttctcatggtgaagactaagatactttttcaaaattactaaattttcatttgtttcatcagggatgaggttgggggaggatcta

SEQ ID NO: 39705 - DNA, 446 bp, Homo sapiens
  misc_feature 25, 403, 421, 436: n = A,T,C or G
accagcattgttaacggctgcggcncgaagtggctgtgggtattgctgcggctggtgcgtcgtcgctctagccagtaaatgacctgcgacataactatttgcaaaacaaatggggaagaccaagataaagataagttatatcacaggaaagcaattgaaaatgcaaaaatgaagcatctgaatgaaggactaataacactgaattcagcttttgtgaatcttatctgcagatatgtacagaccacatcctaagattgacttctgcctcaacagaaatacatgagccagtgccttattggaaatgatttgcgtgttttaagaactggtgtatataggtacatcttgaatgttctgctttccttgccttatgcctgtacttcacctcagccttcaattccattgngtttccttgctacttggnatcttgaaatctggnacgaaactat

SEQ ID NO: 39706 - DNA, 309 bp, Homo sapiens
  misc_feature 23, 178, 179, 180: n = A,T,C or G
gcagacattatgtacaaaggtgnccgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatcnnncaatgctatccccactttttcagcatgggtcattgaagagtggggcgaatgttctaagtcatgtgaattgggttggcagagaagactggtagaatgccgagacattaatggacagcctgcttccgagtg

SEQ ID NO: 39707 - DNA, 426 bp, Homo sapiens
  misc_feature 391, 411: n = A,T,C or G
atatgtggagggcaagagaggacatcatttggaatggtgaatctttaccgggacagttttgccccctaggaacattcagcaatgtctggaaacagaaacacaacccagtgggtgttaatgcccactgtaggtaggggccagggatgctgctaagcatcctacattgaaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctntcctacattggaaagggtanctcccacgaccaaga

SEQ ID NO: 39708 - DNA, 497 bp, Homo sapiens
  misc_feature 23, 25: n = A,T,C or G
ctctcccggcaggtgcgatgctncngtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccactaaagtgaaaagcctaaatgacatcacagcaaaagagaggttctctcccctcactaccaacctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattgga

SEQ ID NO: 39709 - DNA, 228 bp, Homo sapiens
  misc_feature 33, 37, 61, 170, 173: n = A,T,C or G
ggaaaacccctttatctttgtgagaatgaaagntttngcaaataatgtcgagtattattangaaaatgtttttgacctttcctgaaagggtctgggggactctctggaatccccagactccactttgaaaattactgggctacatggaaaaaaaaaattaaggaacttancanctaaagagagatttcatgatttcagagaggttttggatataagatcagtgtcctc

SEQ ID NO: 39710 - DNA, 433 bp, Homo sapiens
  misc_feature 6, 7, 32, 394: n = A,T,C or G
gattcnncccctctctacaaccctctctcctnattgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggntggggggtctgccagctggggccctccctgtcgccagtg

SEQ ID NO: 39711 - DNA, 283 bp, Homo sapiens
  misc_feature 4, 31: n = A,T,C or G
ctgntcactgttaagatggcccttgacattnatattgccacctacaggaagctgctggcaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagc

SEQ ID NO: 39712 - DNA, 146 bp, Homo sapiens
  misc_feature 18, 20: n = A,T,C or G
cctgggttgttgagactntnccgaagatggcttgcgctgccgcgcggtccccggccgaccaggacaggtttatttgtatctatcctgcttatttaaataataagaagaccatcgcagagggaaggcgaatccccataagtaaggct

SEQ ID NO: 39713 - DNA, 478 bp, Homo sapiens
  misc_feature 5, 31: n = A,T,C or G
atttnccggtcttggctgcctgtgggctttntaggtggcctagaggtgggcaaagggaagtaacagacacacgatgttgtcaaggatggttttgggactagaggctcagtggtgggagagatccctgcagaacccaccaaccagaacgtggtttgcctgaggctgtaacctgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggagggccaaaatcaagagtgagatgtagaaagttgtaaaatagaaaaagtggag

SEQ ID NO: 39714 - DNA, 319 bp, Homo sapiens
  misc_feature 26, 86, 136, 148, 151, 178, 218, 250, 280: n = A,T,C or G
tgccgagaaatctgagtttcggcccncagccaggtctggaaactaatattttaaaaatgactacaccaaacaagacacctcctggngctgaccccaagcagttggaaaggactggaacagtacggggaaattgggncacaagctgttnggncacttctcatcttgcaaaccaggattngggggggatcagttacgagatgacaatctagaaacttatnggcaatcaagatggttcccagcctcatttagngaacatccaattcagaagaaaaacaacagngaagacattatgtatttatgcagactacaaatctgatga

SEQ ID NO: 39715 - DNA, 467 bp, Homo sapiens
  misc_feature 8, 32, 71: n = A,T,C or G
gaaacccncccctctctacaaccctctctttnttttcgcttcttctttcttggtttgaccctgactgctgncatggcgtgccctctggagaaggccctggatgtgatggtgtccaccttccacaagtactcgggcaaagagggtgacaagttcaagctcaacaagtcagaactaaaggagctgctgacccgggagctgcccagctttcttggggaaaaggacagatgaagctgctttccagaagctgatgagcaacttggacagcaacagggacaacgaggtggacttccaagagtactgtgtctttcctgtcctgcatcgccatgatgtgtaacgaattctttgaaggcttcccagataagcagcccaggaagaaatgaaaactcctctgatgtggttggggggtctgccagctggggccctccctgtcgccagtgggcactttttttttttccaccctggctcct

SEQ ID NO: 39716 - DNA, 480 bp, Homo sapiens
  misc_feature 433, 477: n = A,T,C or G
gaaagcccggcatctcaaatcggctgattctgcttctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaagacggaaagatcaaagtgttaaaccaggagttgagagctgatggaactgtgaatcaaatcgaaggtgaagccaccccagttaacctcacagagcctgccaagctggaagttaagttttcctggnttatgccatcggcaccgtactggatcctggccaccgactatganaac

SEQ ID NO: 39717 - DNA, 312 bp, Homo sapiens
  misc_feature 1, 6, 33, 59: n = A,T,C or G
nattcncttgtaacttgacttcttttttttttntgcttaaaaatttcaattctcgtgcnaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggcc

SEQ ID NO: 39718 - DNA, 229 bp, Homo sapiens
  misc_feature 6, 7, 8: n = A,T,C or G
gactcnnngcggtggatcatatgaggaggctttttagttcgaggtcagcctggccagcctagcgaaaacttgtctctactaaaaatacaaaaattagtcaggcatggtggtgcaccgtctgtaataccagcttctcaggaggctgaggcaccgaggatcacttgaacccaggaggaggaggttgcagtgagctgagatcatgccagggcaacagaatgagactttgttt

SEQ ID NO: 39719 - DNA, 238 bp, Homo sapiens
  misc_feature 9, 33, 61, 214, 217: n = A,T,C or G
aaaagcccngaggaaactgtaagcccttgctgnttttcttcagccctggtgtgagccccantcatctgtacttagtccacagctctgactcacagatgccatgtttgcacagccctatttatggcccttgtctttccagagatatgccgttgggagtgcatttggccattcttgtcaaaataagccaagggatatcttatctaccccaggtggnttnggctctgctagcctttgcttg

SEQ ID NO: 39720 - DNA, 222 bp, Homo sapiens
  misc_feature 51, 101, 116, 136, 192, 210: n = A,T,C or G
gaggcagccagcgcaggggcttcttttgagggggcaggcggagcttgaggnaaccgcagataagtttttttctctttgaaagatagagattaatacaactncttaaaaaatatagncaataggttactaagatatngcttagcgttaagtttttaacgtaattttaatagcttaagattttaagagaaaatntgaagacttagaagagtngcatgaggaagg

SEQ ID NO: 39721 - DNA, 307 bp, Homo sapiens
  misc_feature 24: n = A,T,C or G
atgcctctcgcaaaggatctcctncatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttac

SEQ ID NO: 39722 - DNA, 500 bp, Homo sapiens
  misc_feature 3, 23, 320, 356: n = A,T,C or G
cgnacgatgtgcattaactatgnccccactaaaagatccattgtaatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataactgaccccaaaaagncagataaaagtaaaaaaacaaaagtataaatcatgncatccctcccccatttgcaccgacatctctaaccacagacacacacacgcacaccatacgcaaagatagtcaccataattgaccatgtttttcaccttttagtcaatgttagaagcaaggggtaccttaagtcctggggggaag

SEQ ID NO: 39723 - DNA, 495 bp, Homo sapiens
  misc_feature 4, 12, 71: n = A,T,C or G
cttnggccgggnaaaaccccggagggacagactgttaacatccttttttgtagatgaggatgaggctaagnggaattaagtaacttgctcaaggtcaaacaggtgacagagccagaattccaaaccagcctagtctggaatattccagataccacactcttcacaggttcccaacacttgaacataaacactcaataatctgtataatacatcaagtgcccacttttcttattgtcatctttgtattaattcaaaattggcttttgtatccagggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgcca

SEQ ID NO: 39724 - DNA, 143 bp, Homo sapiens
catggtggtgggcaccttgtagtcccggctattcaggagactgaggcaggagaatcacttgaactcgggaggtggaggttgcagtgagccgggatcacgccgctgcgctccagcctgggtgacagagcgggactccatctcat

SEQ ID NO: 39725 - DNA, 105 bp, Homo sapiens
  misc_feature 96: n = A,T,C or G
gtggagacggattacaccttcccacttgctgaaaaggtcaaggccttcttggctgatccatctgcctttgtggctgctgcccctgtggctgctgcnaccacagct

SEQ ID NO: 39726 - DNA, 151 bp, Homo sapiens
  misc_feature 2, 4, 27, 53: n = A,T,C or G
tngnttaaaccaacctatccaaaaccnatccagagggaaagaagagaagtggnaagaaaaattgttccaactaccacaaaaagaccacacagtggaccacggagcaacccaggcgctggaagactgaataatgaaaccagacccagtgttc

SEQ ID NO: 39727 - DNA, 497 bp, Homo sapiens
aatgttccacccagtggcatatgcgttcacatattatcaatgctagatgcttcaagcttgcaaacagagccctactgaggaaatgtacatctcttgtggatttatctaaacacataagccttttatttaatttgaaattagtaatcatgtatagctgaccatttacagatttaatccctttatgcatattttgccttatcttccacattgaatgccaccaaagtgatctgcctaaagctcaaatctggtcatgtcagtttcataccaaaaattctatatcaccaatgataaaatctaaactaaatctgaaccaatcgtaagcaaactaccttccacttgccaaatgtgtcatgctcgcttgtgtctctactccttttcaaatattgtcccacatcctaaaatatcattttcatgcctttcctattaaaaaaataatttccctttctcttggtttcagatacattctcagctactctgaaaaacctgtaacactttct

SEQ ID NO: 39728 - DNA, 129 bp, Homo sapiens
  misc_feature 80, 128: n = A,T,C or G
tggaatattgtttttctagaggacattcatatctgcactattatctgatgacatgttggtaattttaaagactgcaaggnggtttagagaatgaagtaaaccaatagatactcttttgattctccatnt

SEQ ID NO: 39729 - DNA, 217 bp, Homo sapiens
  misc_feature 20: n = A,T,C or G
ctttgtacttatctctgtcncaaactcttgctttactctttgttctcccagcagtttttggtttaatttctaatgtgtctaatttgtgtaggcgtcgaccagaagattatgatattcataacagcagaaagaaaccaaggattgactatccccctgagtttcaccagagaccaggttaatattttataatcctgcagatatttgatttcaaattatt

SEQ ID NO: 39730 - DNA, 131 bp, Homo sapiens
  misc_feature 28: n = A,T,C or G
tgcccaggccccctcccgagcccctggnctccctagagccactccccactgtcgggacacctcatctgtgctccccaaaacgccactgcactccagcctgggtgacaagagcaagattccgtctcaaaagg

SEQ ID NO: 39731 - DNA, 494 bp, Homo sapiens
  misc_feature 175, 429: n = A,T,C or G
agagacaaggcagacaaagcctcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttggnggcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgngattccttgcaacaatcaatgagaatcttcatgtattctggagaacaccattcctgatttcccac

SEQ ID NO: 39732 - DNA, 489 bp, Homo sapiens
  misc_feature 1, 8, 65: n = A,T,C or G
naactgcnccaattttagaatttggaacaagtgttttctatatttgataataattagatcctgcntcataacactaaaagtttacaagaacatgcagttcaatgatcaaaatcatgttttttccttaaaaagattgtaaattgtgcaacaaagatgcatttacctctgtaccaacagaggagggatcatgagttgctgccactcagaagtttattcttccagacgaccagtggatactaaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatatttt

SEQ ID NO: 39733 - DNA, 128 bp, Homo sapiens
  misc_feature 128: n = A,T,C or G
gacagctggcctgtctccttcacctagtccatatcaccacaaatcacacaacaaaaaggagaagagatattttgggttgaaaaaaaagtaaaaagataatgtagctgcatttctttagttattttggn

SEQ ID NO: 39734 - DNA, 113 bp, Homo sapiens
  misc_feature 16, 23, 108: n = A,T,C or G
acagcttgtggcaagngaatccngcctgtaacaagccagattttttaaaatttatattgtaaatattgtgtgtgtgtgtgtgtgtgtatatatatatatatgcacagntatct

SEQ ID NO: 39735 - DNA, 254 bp, Homo sapiens
  misc_feature 174: n = A,T,C or G
cttatttcttataatatgaatgctgatatttaaaggtagatctatgtggtattctttgcgtttcttaattgtttaactcttaagattatttgtgatctggatttatgtatttgttagatacatacgaattgttaaaatggaatgcaagtttttcaaaagcccaggtctaaatgnaatggttggtttattgttctataaccccagcccatcattttctgtgtaaatcataaacaataaacagaatatactcggcc

SEQ ID NO: 39736 - DNA, 139 bp, Homo sapiens
  misc_feature 4, 13, 27, 62, 82, 83: n = A,T,C or G
ctgnccactcgcnccacttcgcttgcnatcacagcacgcctatcggatgtgagaggagaagncccgctgctcgggcacctgnntatatacgcctaacacctacatatattttaaaaccattaaatataattaacagttc

SEQ ID NO: 39737 - DNA, 255 bp, Homo sapiens
  misc_feature 1, 21, 42, 65, 136, 185: n = A,T,C or G
ngtaaatataaaataagaaanccaaatgaaaaaaaatcaagngcaccattgctacattaaaatgnaaaaggactaaataccccatgtaaagaaagattaggaatgtgttggatcaaaataaaagcacacatgagtngcttacaaaaactatactttaagcaatatttcttaaaggggggggaagngaaaagatgaacagaaatatacaagacaaagagcaaacaaaataaaaacactaagagcaatttgtattgc

SEQ ID NO: 39738 - DNA, 424 bp, Homo sapiens
  misc_feature 22, 52, 72, 176, 402: n = A,T,C or G
gaataagcaaagcccatggaanccaatttttcattgtgatcagattaaaatnactatttgtgcaaaacaaantccacaccacatgtactgtatattctaatctgctgagaaaggtggtcaggcccttctaaatgcttaaccaaaaacaaacattattggagtttcagtgtaaaatnaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggntcctcttgttttggttattttg

SEQ ID NO: 39739 - DNA, 140 bp, Homo sapiens
  misc_feature 17, 24: n = A,T,C or G
gctgcagatccaggctnttctgcnaaagtgaggccaccatggctctggagaagtctcttgtccggctccttctgcttgtcctgatactgctggtgctgggctgggtccagccttccctgggcaaggaatcccgggccaag

SEQ ID NO: 39740 - DNA, 421 bp, Homo sapiens
  misc_feature 230, 347, 382, 386: n = A,T,C or G
gagggggcaggcggagcttgaggcaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtngagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttgngggngattaaaataatttgaaggcgatcttttaaaaaga

SEQ ID NO: 39741 - DNA, 341 bp, Homo sapiens
  misc_feature 25, 178, 179: n = A,T,C or G
cagacttaagcgtccctgtctgacngctctgaagagagcagtggttctcccagcatggtgtttgagctccgagaacagacagactgcctcctcaagtgggttcttgacccccgtgtagcctaactgggagacacctcccagtaggggccgactatcacctcatacaggcgggtgtccnnctgggatgaagcttccagaggtaggatcaggcagcaatatttgctgttctgcagcctctgctggtaatacccaggcagacagggtctggagtggacctccagcaaactccaacagacctgcagctgagggacctgactgttagaaggaaaactaacaaacag

SEQ ID NO: 39742 - DNA, 252 bp, Homo sapiens
cactggatgctggacccctgccagcagtacctttgctaccagaacagagtctcctccagccctgcccctctgtagcactagctcctggtcagatctaggcagaaatagctgggcaagtcactggcccatctactagctgtaaggaggcctagaaaggagtatctcacttctgctgggagaaaggggctttgcctgcaaccacagctcatactctgggaaattgcttaaacaaattctagacaggaacaaaac

SEQ ID NO: 39743 - DNA, 426 bp, Homo sapiens
  misc_feature 23, 25, 115, 179, 180, 341: n = A,T,C or G
tggtggccgcaaagaagacgaancngtcgctggagtcgatcaactctaggctccaactcgttatgaaaagtgggaagtacgtcctggggtacaagcagactctgaagatgatcangacaaggcaaagcgaaattggtcattctcgctaacaactgcccagctttgaggaaatctgaaannggagtactatgctatgttggctaaaactggtgtccatcactacagtggcaataatattgaactgggcacagcatgcggaaaatactacagagtgtgcacacctggctatcattgatccaggtgactctgacatcattagaagcatgccagaacagactggngaaaagtaaaccttttcacctacaaaatttcacctgcaaaccttaaacctgcaaaattttcctttaataaaatttgcttgtttta

SEQ ID NO: 39744 - DNA, 154 bp, Homo sapiens
  misc_feature 24: n = A,T,C or G
accccttccttgtactatccctangaggcataattataacaagctccatctgcctacgacaaacagacctaaaatcgctcattgcatactcttcaatcagccacatagccctcgtagtaacagccattctcatccaaaccccctgaagcttctt

SEQ ID NO: 39745 - DNA, 437 bp, Homo sapiens
  misc_feature 17, 175, 397, 401: n = A,T,C or G
actggcccccaacaggnatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattngaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgngggnttgactattttctgtatgtctccatctattgatgag

SEQ ID NO: 39746 - DNA, 377 bp, Homo sapiens
  misc_feature 16, 23, 175, 336, 354: n = A,T,C or G
tctaaatccccttgtnaatttanctgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatntaactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagncattattaccctcactgncaacccaacacaggcatgctcac

SEQ ID NO: 39747 - DNA, 201 bp, Homo sapiens
  misc_feature 131, 176, 184, 200: n = A,T,C or G
gaagtttgcttacctttaaattctaaaactttaaaaacttttatcacaattttttcactaaataatttgagcaggcagggcgcaatggctcacacctgtaatcccagccctttaggaggctgaggcaggtnatcacctgtggtcaggagctttgagaccagcctggccaacatggngaaacctnatctctgctaaaaatnc

SEQ ID NO: 39748 - DNA, 499 bp, Homo sapiens
  misc_feature 24: n = A,T,C or G
aaatgggaccggattgcccctgcnagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcggaagtttgacaggcgattctcccctcattttctggactgggcagcctttggggtcatgacccttccctccatcggcatccccccgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagggaaggaccagccctaggagtctgc

SEQ ID NO: 39749 - DNA, 201 bp, Homo sapiens
  misc_feature 7, 11, 54, 62, 103, 135, 136: n = A,T,C or G
gagtccnaccngcctggcagtatgatggcctagatgcagagaaaacagctcctnggggaatngataagtaaaggcagaaaagattatatgtcatacctccatnggggaataagcataaccctgagattcttactnntgatgagaacattatctgcgtgggccaaaaaattttaagcaaatgaaagctaccaatttaaagtt

SEQ ID NO: 39750 - DNA, 453 bp, Homo sapiens
  misc_feature 23, 179: n = A,T,C or G
cgagtctgaggcggagggagtancggcaggacaagcgtttagaaagtttcttccactctttgaccgagtattggttgaaaggagtgctgctgaaactgtaaccaaaggaggcattatgcttccagaaaaatctcagggaaaagtattgcaagcaacagtagtcgctgttggatcggggnctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatga

SEQ ID NO: 39751 - DNA, 456 bp, Homo sapiens
  misc_feature 25, 64, 155: n = A,T,C or G
acgcattgattcttgtcaacaatanaattagcaaagttagtcctggagcatttacacctttggngaagttggaacgactttatctgtccaagaatcagctgaaggaattgccagaaaaaatgcccaaaactcttcaggagctgcgtgcccatganaatgagatcaccaaagtgcgaaaaggtactttcaatggactgaaccagatgattgtcatagaactgggcaccaatccgctgaagagctcaggaattgaaaatggggctttccagggaatgaagaagttctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctg

SEQ ID NO: 39752 - DNA, 211 bp, Homo sapiens
  misc_feature 117, 176, 179: n = A,T,C or G
atgacaccggccatgggttaaccgtggctcctcaggaccctctgggtcacacatctttagggtcagtggccaatggggcacatttggcactagcttgagcccaactctggctctgcnacctgctgctcctgtgacctgtcagggctgactttcacctctgctcatctcagtttccnaanctgtaaaatgggtctaataaaggatcaaccac

SEQ ID NO: 39753 - DNA, 359 bp, Homo sapiens
  misc_feature 24: n = A,T,C or G
cagtaggaatgagccccaaaaggngtgcatagaggagctagtttgggtgaaccattaaaataaattttttttaaggccgggtgaggtggctcacacctgtaatcccagcactttgagaggctgaggcagccagatcacttgaggtcaggagtttgaaatgagcctggccaacatggggaaatgctgtctctactaaaaatacaaaaattagccaggcatggtgacacatgcctgtaatcccagctactccggaggctgaggaaggagaattgcttgaacccgagaggtggaagttgcagtgagctgagattgcgccacttgcactccagcctgggcagcaagagtgaaactccatctca

SEQ ID NO: 39754 - DNA, 119 bp, Homo sapiens
  misc_feature 16, 20: n = A,T,C or G
gcaaatacgtagactnggancgacatctctacaccgttcccatccgggaacagggcaacatctacaagcccaacaacaaggccatggcagacgagctgagcgagaagcaagtgtacgac

SEQ ID NO: 39755 - DNA, 197 bp, Homo sapiens
  misc_feature 178, 181: n = A,T,C or G
tagccgaagctgacactcacagcacgtatatgttatccttcaaacaaaaaaatcctaagtttgtcctaactttatctgacccattttttaatgctctctaacattagtgaatgatataatgtttatgcagaattagataagcttatgttaagcttttcacaaggctaaacagttgggngcntgaattttgggagcac

SEQ ID NO: 39756 - DNA, 425 bp, Homo sapiens
  misc_feature 14, 22, 174, 175: n = A,T,C or G
ccatttcagagggnggagggancatccaggatgtctcaaaaggtctgctttcctcattgtctcagcttcccctctgaagctcactcccccccaccgctttcttgatgttttttctcttgtcccatttgaactgcaagaagtgcccctcccattcttggaccacctggaagcttnngagcaagcttttggaaaattatctgttttgtgcattgcaatagaaaactcaaatgaaaggagccagatgggattgagggctgggaagcgaacagggagaaatgaatcatcttgggcctcatctccagagtccttgtccaaacctgggcaattcttatccccctctgtccctctctttcctctccccttctcccttcccatggctttttatgataatgcttttcaagctcccaataagaacaacgttttac

SEQ ID NO: 39757 - DNA, 119 bp, Homo sapiens
  misc_feature 17, 24, 41, 84, 115: n = A,T,C or G
aaatgtttcttattttnagcactnccatcatttggtacacnggggcaaatagggcaaataattttgtctttgtataatagattngatatttaaagtcactggaaataggacaagntaat

SEQ ID NO: 39758 - DNA, 365 bp, Homo sapiens
  misc_feature 33: n = A,T,C or G
gaactcccatccaatatataagcacaatgattncaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccaggctttgtacaagctttacagtgcagcagcaacccacagacatctgtatcatcaagctttccctacaccaaagtcggaatctactgaacaatcag

SEQ ID NO: 39759 - DNA, 491 bp, Homo sapiens
  misc_feature 3, 18, 19, 32: n = A,T,C or G
ggncccctgtaaaaaatnnaggttgtggttanttgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgaga

SEQ ID NO: 39760 - DNA, 175 bp, Homo sapiens
  misc_feature 18: n = A,T,C or G
actgtcctatttttaatntcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctata

SEQ ID NO: 39761 - DNA, 311 bp, Homo sapiens
agaaaataatttagaagaaaattattcttggtcgggtgcggtggctcacactgtaatccaggtcttcggggctctgaggcaggcggattacctgatgtcaggagttttgagactagcccggtcaacatggtgaaaccccttctgtactaaaaataaaaaaattagctaggtgtggtagtgcacacttctgtaatcccagctactggggaggctgaggcaggagaatcacttgaacctgggaggtggaagttgcagtgagtcgagatcatcccactgcactccagcctgggcaacagagtgagactctgtct

SEQ ID NO: 39762 - DNA, 232 bp, Homo sapiens
  misc_feature 35: n = A,T,C or G
tagaatcttagttcaactttaaatttgcccacagnaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcaca

SEQ ID NO: 39763 - DNA, 221 bp, Homo sapiens
gccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcga

SEQ ID NO: 39764 - DNA, 273 bp, Homo sapiens
  misc_feature 37: n = A,T,C or G
cgcagtggctcacgcctgtaatcccagcaccttcggnggctgaggagggcagatcacgaggtcaggagatcgagaccatcctggccaacatggtgaaaccccgtctctactaaaaatacaaaaaattagccgggcgcggtggcgggcaccttgtagtcccagctactcgggaggctgaggcaggagaatggcgtgaacctgagaggcagagcttgcagtgagccaagatcgcaccactgcactccagcctgagcgacagcgagactccgtctc

SEQ ID NO: 39765 - DNA, 390 bp, Homo sapiens
ccctcctggaaaataatgaattgggtaaggaacagttaataagaaaatgtgccttgctaactgtgcacattacaacaaagagctggcagctcctgaaggaaaagggcttgtgccgctgccgttcaaacttgtcagtcaactcatgccagcagcctcagcgtctgcctccccagcacaccctcattacatgtgtctgtctggcctgatctgtgcatctgctcggagacgctcctgacaagtcgggggaatttctctatttctccactggtgcaaagagcggatttctccctgcttctcttctgtcacccccgctcctctcccccaggaggctccttgatttatggtagctttggacttgctttccccgtctgactgtccttgacttctaga

SEQ ID NO: 39766 - DNA, 425 bp, Homo sapiens
  misc_feature 34, 169, 213, 239: n = A,T,C or G
aaggtatgaggggtttgcacctctgttgcggagntgtggaagggtgttaagtagggcctaccatgagcaagattttgagaagatctaatttggcagcctggatgtgagaaggagcaactggaggaaggagagggtccagacagcactgtcagtatttcacactattggngacctgaagggggcggtaataggaggaatggggaggatccaggngcaacagattttgtggatgagggtanacagctctgggagctgagtgttagttacaacaaaggcagttatcaaagataactccaaggtatcaagtaaagatgaaaagcatttaaaggaatcaaattgaattccattttatatagtgcggagtatgagctaccacaggtgttcccagtggagacaactaacactgagttacaaacagggtcctg

SEQ ID NO: 39767 - DNA, 342 bp, Homo sapiens
  misc_feature 211: n = A,T,C or G
cagcatttgtggtgcgttctgagccgtctgtcctgcgccaagtatgcttcaaagtattattaaaaacgtatggatccccatgaagccctactacaccaaagtttaccaggagatttggataggaatggggctgatgggcttcatcgtttataaaatccgggctgctgataaaagaagtaaggctttgaaagcttcagcgcctgctcctggncatcactaaccagatttacttggagtacatgtgaaagaaaacgtcagtctgcctgtaaatttcagcaagccgtgttagatggggagcgtggaacgtcactgtacacttgtataagtaccgtttacttcatg

SEQ ID NO: 39768 - DNA, 418 bp, Homo sapiens
gctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacatttttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattaat

SEQ ID NO: 39769 - DNA, 461 bp, Homo sapiens
  misc_feature 389: n = A,T,C or G
gaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatngagaagatagggaaattagaagataaaaacatacttttagaagaaaaaagataaatttaaacctgaaaagta

SEQ ID NO: 39770 - DNA, 341 bp, Homo sapiens
cttatttaaagataaaataagtcttactttgagtcttttagttgtctatttgccactatgttccagtagaacagaaagtagtaaaacataattttggaattaaactgacatttaaagtaatcagagatacttcaacaacagttttatcacagagcttaatatgattccgatttcatggtgttgtgtgttacagaggataatagaacttatagaatgttttctttcatctggcttttaaaattatctgatttttgacataaggactagtaaacctagagttctgttaatagcaaacattgcctttgagtgctactactaaacctgaggcatcaagaagaaag

SEQ ID NO: 39771 - DNA, 467 bp, Homo sapiens
gagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagaaatggaaacagagagattctcctggaaacccctgccccataaacggccctctcgaacacaatgggacggaatccacccacaacgcgcttggtttgcagatgtcaaagaatctgcagagggtgctacctgaagatccagccttagccaatcaccacctcattgggtgaaagttccagggctcaatccaggaccacactcttattggcca

SEQ ID NO: 39772 - DNA, 477 bp, Homo sapiens
attcctatacatcattaatagacgaacagagagccaaatcataaatgaactcccattcacaattgctacaaagagaataaaatacttaggaatacaacttacaagggatgtgaaggatgtcttcaaggagaactacaaaccagtgctcaaggaaacaagagacgacacaaatgaatggaaaaatattccatgttatgggtaggaagaatcaatatcatgaaaatggccctactgcccaaagtagtttatagattcaatgctattcccatcaagctaccattgactttcttcacagaattagaaaaaactacttcaaatttcatatggaactgaaaaagagcccgtatagccaagacagtcctgagcaaaaagaacaaagctggaggcatcacactacctgacttcaaactatactacaaggctattactggtaccaaaacagatataaagaccaatggaacataacagaggcctcag

SEQ ID NO: 39773 - DNA, 279 bp, Homo sapiens
aggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaagatgcccatgttggtcctctgccctggacctgtgacattctggactatttctgtgtttatttgtggccgagtgtaacaaccatataataaatcacctcttccgctgttttagctgaagaatc

SEQ ID NO: 39774 - DNA, 313 bp, Homo sapiens
  misc_feature 14, 25, 40, 41, 43, 44, 50, 58, 89, 90, 91, 105, 208: n = A,T,C or G
cttggtcttattancagtgctatgntatgtaaaaggaatnnanntgtaangaatattntctttgaaacaataatacctgtttttttatnnntagaaaagaaaagngctgtgggaaatacagagatgacttgtaaataaattctgcccacaggcttaggggatctaagatataattcactgtggtaaaagatacaaagcaatcatttgncagaaaaagatacagattaagtgccatagaagttctgctgaagaagaatttctgggtaaagggaaggagacttcttagaggatagatggattttagttctaggtg

SEQ ID NO: 39775 - DNA, 229 bp, Homo sapiens
  misc_feature 2, 11, 33, 42, 54, 55, 62: n = A,T,C or G
anccctcttcntgggaaagtaattgctgagccnagtacagcnacaaacagtacnncttttgnagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttca

SEQ ID NO: 39776 - DNA, 477 bp, Homo sapiens
  misc_feature 7: n = A,T,C or G
aacaganaggtggaacttttttcctcttcttccttaaacaataagtaggaatacaatctacttcctttactaggagaataaaatgctggttcttatatgtgctacttattttgtagttactaaataaactttactaatgaagtttcacttttactgccattaaaaactatcatctcctgagagatttagtatatcctggccttttatttaacaatttttatttattatctttgggccttttaaagtttggtgtttataaacaccaaacttctataaatattacaaaaatatatgcctttctaagaaatatttgcataatttaatgtttctcctgctcatttccaggtctcttcaactggaatgctcatgagtataatcatgctagcttttcattttacttttctctagtgtaataattaagtcaaagacttaatttatatctaatatatcctttatcatagcataaaattcaaactg

SEQ ID NO: 39777 - DNA, 102 bp, Homo sapiens
gtcatctctgatctttgcctaatctgtttctttttccttttcccctagttcttacaggtttcgttgtgttttttaatctaataaaatagaaagatccctgtg

SEQ ID NO: 39778 - DNA, 471 bp, Homo sapiens
  misc_feature 2, 20, 34, 42, 115: n = A,T,C or G
gncctatgacattggtggtnctgatcaagaattnggtgtggncgttggccctgtgtgctttttataaaccaaactctatctgaaatcccaacaaaaaaaatttaactccatatgngttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattaggaaaagccctccctatt

SEQ ID NO: 39779 - DNA, 225 bp, Homo sapiens
gaggctgattcctctcatttccgcttctcagtttctgcctgggcaatggccaggggccaggagtggggagagttgtgatggaggggagaggggtcacacccaccccctgcctggttctaggctgctgacaccaaggccctgatctgtctgctctgaatatatgtctctttggagttggaatttcattatatgttaagaaaataaaggaaaatgacttgtaaggct

SEQ ID NO: 39780 - DNA, 288 bp, Homo sapiens
  misc_feature 6, 31: n = A,T,C or G
tctctntgacttcccttattttgaaatatanaacctactatttgttacatatccaaattgtgtcatatgatattttttacttccttttcatctacagaagaatctctaattcactccaaattaatcttttaaaatttatatcaatattattactaataatattgctaagaaacagattcttacttggaagcggttttgccattgtttcctgctaataaacaattcagaaaaactaatgtattagaactgaaggtagaacaacacgaaaatcatttcagaaattgtaag

SEQ ID NO: 39781 - DNA, 170 bp, Homo sapiens
aacagcaaaaatatatatatgattgaatttccagcaagagaagatatttatgccttatttgggaataaaagcagtatttgaggaaatgctggtagagatttccagaactgatgaaagacaagcattaagataaaaacaaggagttctgtccaccctaaacaagataatct

SEQ ID NO: 39782 - DNA, 475 bp, Homo sapiens
attccagcaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccactttcaaccaaaatcgatatcagcaatgtaaaaatcccaaaacatcttactgatgcttacttcaagaagaag

SEQ ID NO: 39783 - DNA, 191 bp, Homo sapiens
  misc_feature 10, 33, 38, 43, 72: n = A,T,C or G
cggctccctntggcccgggaaccagccaaactntctcnctgangtgaatttccagaagagtaagatatttantgcattatttgggaataaaagcagtatttgaggaaatgctggtagagatttccagaactgatgaaagacaagcattaagataaaaacaaggagttctgtccaccctaaacaagataatc

SEQ ID NO: 39784 - DNA, 293 bp, Homo sapiens
  misc_feature 7, 9, 34: n = A,T,C or G
ctcggcncntttggccgggagggttggaaagtcnagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaatc

SEQ ID NO: 39785 - DNA, 149 bp, Homo sapiens
gaaaaaatgtttttacaataggaattgcagatttctacttgctttatataaggagcacatacatagaatgtcagaaagtctccgaagtatatacatattaaatataacccactgaattgtacacaaaattttgaaacaccaaacaacag

SEQ ID NO: 39786 - DNA, 479 bp, Homo sapiens
cagacgaggtcatgaatcatgcgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccatt

SEQ ID NO: 39787 - DNA, 477 bp, Homo sapiens
  misc_feature 9, 10: n = A,T,C or G
aaacaaaannctggctttaggcgtggcttgtagaatcaatctaactactagacaagttacatctcatatatgtgtggcttctttttcttcttttcgggggctacaaggaaggtttggagaaattatttccatcatacctttttgttagcctttttccatttctggccagtaagtaatcccgttcctgacaacagtccctttgttttctcaagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggtcacagcttggggtgttcagca

SEQ ID NO: 39788 - DNA, 448 bp, Homo sapiens
caaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgact

SEQ ID NO: 39789 - DNA, 459 bp, Homo sapiens
gaagcatttgctgctgaaatttagcacgtggtgctcctccccgcccaaaccatttatttgttccaaattaccttgcagactgcttggatattgaattttagagagaacggagagccacacaaaatatttttatgaatatccattggcttgtggccaagtcttcccatcttttcaaatgaaggtgttttggtcttcctacagaagaaagtatggagaaggcgggtctgaagctcgagaaaatgaattgttgctcaaactgtggtttcctcttggtcctaaatcagcctgttcttatgaagtgctcacagcctcacgggcgtcatgagagcctaacccccccaggagggtgcccagtggaataccttaagcctgtgtattctcatatacatgtagaaataagatgacaacataaaagggccgttctgccgtcatttttctgaacttcttcactcagtcaag

SEQ ID NO: 39790 - DNA, 225 bp, Homo sapiens
attgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggcaag

SEQ ID NO: 39791 - DNA, 361 bp, Homo sapiens
atttttatgttttattagcattttcagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactgc

SEQ ID NO: 39792 - DNA, 296 bp, Homo sapiens
aagactgggacgtctagtccacaggaaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttcct

SEQ ID NO: 39793 - DNA, 202 bp, Homo sapiens
gttcagggagattactatggagatctggctgcttgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagttc

SEQ ID NO: 39794 - DNA, 324 bp, Homo sapiens
agctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaattttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatcttcg

SEQ ID NO: 39795 - DNA, 479 bp, Homo sapiens
ataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaagg

SEQ ID NO: 39796 - DNA, 457 bp, Homo sapiens
  misc_feature 115: n = A,T,C or G
catctgcaggtacaacttgccaatcatactgttggtagtgaataacaatggaatttaccaaggttttgatacagatacttggaaagaaatgttaaaatttcaagatgctactgcngtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgac

SEQ ID NO: 39797 - DNA, 309 bp, Homo sapiens
  misc_feature 70, 307: n = A,T,C or G
caatttccttttttgaacagaagctttactctttactgagcatctactacgtgccaggtgggtcctcccngccgacatcttcagtgctgctgtgggtgagtcaggctttggtaggtccagttggcacctttggcttctttttcttcatcttgtggaaatgcaagggtcattccggttctgcttccagtgatgggcgaatctgtattaactggtagagtgagggtggggggatatgtgccagcattgagtggcagggctgagttgggtgagttcgagttcatttcattttgggggggtctgctgtgtntc

SEQ ID NO: 39798 - DNA, 217 bp, Homo sapiens
  misc_feature 2, 14: n = A,T,C or G
angagccccaggantttgaggttgtggtgagctatgattgtgcagctgtactacagccttggtgacagagcgagaccctgtctctatttaaaaaaataaaaaatcacagtggtttgtgtgaggcttgtcatgttttgtttgggtgatgaataatgaaatatggacatgtttactggatctttaaacaccagattttgtggtagcaaataacttatcg

SEQ ID NO: 39799 - DNA, 449 bp, Homo sapiens
gtttgatgtctttgccaaaaagaaccgggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttca

SEQ ID NO: 39800 - DNA, 239 bp, Homo sapiens
  misc_feature 15: n = A,T,C or G
gcattttgggatgcnaaggtgggcagaccatttgaggccaggagttctaaaccagtttggccaacatggcaaaaccccatctctactaaaaatataaaaattagctgggcatggtggtgcacacctgtaatcccagctacctgggaggcacgagaatcacttgaacccaggaggcggaggttgcaagtgagccaaggttgtgccactgcactccagcctgggtgacaaagcgagactgt

SEQ ID NO: 39801 - DNA, 143 bp, Homo sapiens
aatgaaagaatttcctgatcaacatcattaaagattatgtaaaaagttaaaaggcttatgagcctaagtttgttcctatattaccatatttactgaattttctggaaaagtaactttaataaagtttaatctcagaaattgtc

SEQ ID NO: 39802 - DNA, 463 bp, Homo sapiens
gagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacat

SEQ ID NO: 39803 - DNA, 275 bp, Homo sapiens
cgcagtggctcacgcatgtaatatcaacactttgggaggccgaggcgggtggatcatctgaggttgggagttcaaggccagcctgaccaacatggagaaaccccgtctctactaaaaatacaaaattagttgggtgtggtggtatatgcctgtaatcccagctactcaagaggctcaggcaggagaatcgcttgaacccgggaggcggaggttatagtgagttgagatcgcaccactgcactccagcctgggcaacaagagtgaaactcagtctc

SEQ ID NO: 39804 - DNA, 404 bp, Homo sapiens
  misc_feature 214, 238: n = A,T,C or G
gagaaaagagaagaatcaaagatcaccccaagtttttggcttaggcagctggtaaaatggagatgctgtttacttgagatggaattaaaggtaaggacattttggtgttggtgttggtaatctatagtcttaggacatatactagaataaaatatttacttcctactcgttttttttttaaactaacatttattctactttttatgaataaatngtatcctttctgaagagctaatgngtttgggattaattttgctacatggggatgtggggttttaaggagtaaaacacagtaataacttttggctggggttacaggcttgagccattgcacccagccccctaattattcttactctatactaagttctttttttcccctacctttgtaaatgtaggcattc

SEQ ID NO: 39805 - DNA, 106 bp, Homo sapiens; identical to SEQ ID NO: 27192

SEQ ID NO: 39806 - DNA, 294 bp, Homo sapiens
  misc_feature 4: n = A,T,C or G
aganttacacgactgtattattattttgttcttaagagaatcacatgggaaaactgtggagaaagaaaggcaacaaagtaaatattagtgtttaatgactagatgtgtgagatatttatattacatattataataaatttaatgcttcatgacattgatctgtatgtaatttaaagagatgctcaaaattcagatcattggaataataagcaaggtagttttacattgctgaaaaaggtacatctaaaggcaatgtatttcttattgaaaattttgttgatagctgagccgttc

SEQ ID NO: 39807 - DNA, 426 bp, Homo sapiens
atgagaggtgtagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccggttggcaggagaggatgccggagatctctgcctttgagctgcagaccatcctgagaagggttctagcaaagcgccaagatatcaagtcagatggcttcagcatcgagacat

SEQ ID NO: 39808 - DNA, 419 bp, Homo sapiens
atctgcgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcaccgagaatcacttgaactcaggagatggaggtttcagtgagccaagaccacaccactgcactccagcctggcaacagagcgagactccatccca

SEQ ID NO: 39809 - DNA, 460 bp, Homo sapiens
gctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtca

SEQ ID NO: 39810 - DNA, 421 bp, Homo sapiens
ctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattttgtggccgagtgtaacaaccatataataaatcacctcttccgctgttttagctgaagaatt

SEQ ID NO: 39811 - DNA, 455 bp, Homo sapiens
gtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaac

SEQ ID NO: 39812 - DNA, 468 bp, Homo sapiens
  misc_feature 136: n = A,T,C or G
atctcatggatttgttaggagttctcttgtattttctgtattttatgtctgttgccaatgttttctcctacttagccatttggctttaattttacatggtgtctgtttaaataaatgttttatatttgtatacaantcaaattgattaattttcatgacttatttcaggatataaagcaaattattttctaagacatttacagtgtattgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgt

SEQ ID NO: 39813 - DNA, 425 bp, Homo sapiens
gcacatgattctccccgtgacgaagcactgcagaacatctcggctgatgatctcccagactctgcaagccaagcagcccacccgcaggattcagctttctcttacaggtatttcttttataggatttgggactttagggtttggacttttcagcaccattgcagtcacgtcaagtcaagtgatgttttgagtcaataaatgtataaagcagggagagaaaaatgaaatgctgtttactaagaagactttgtttcagttgtagatgttatgtatcaaaaggtgttaattcaaggatttaaaaaactcgctgggcgtggtggctcacgcctgtaatcccagcactttaggaggccaagacaggcggatcgctggagcccaggagttggagaccagcttgggcaacatagcaaaatcccatctctaca

SEQ ID NO: 39814 - DNA, 140 bp, Homo sapiens
aagaggtgaactggacgttgtgaacagagttagctggtaaatgtcctcttaaaagatccaaaaaatgagacttctagcaaggattatttgccttatgttatgggctatttgtgtagcagaagattgcaatgaacttcctc

SEQ ID NO: 39815 - DNA, 484 bp, Homo sapiens
gaaggttttctgcaacatggaagactggcgagtacttgcgtctaccccaatccagcaaacgttcccaagaagaactggtggagcagcaagggcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggag

SEQ ID NO: 39816 - DNA, 292 bp, Homo sapiens
gtttgaggttaccagtaaattttatttttctgtttactttagacctttgtctgtagttgtagaattgaagcagcaagctctccgtgtgtctctgtgtcaataattgagaaaggcatttcctttttattgtgtgtgcatgaaatatttcctacctctggagggtattaatacattaaagctataaaacctcttaaattaaagaagctctgttctgcttggttcgtagagaacaataagaaccacataaatttaatgtttacagaattcttataaaataaagaaactgaacttc

SEQ ID NO: 39817 - DNA, 101 bp, Homo sapiens
cacacctgtaatcccagcactttgggaggacgaggcaggcaaatcacctgaggtcaggagtttgagaccagcctggccaacatggtgaaaccctttctcta

SEQ ID NO: 39818 - DNA, 167 bp, Homo sapiens
gtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggtt

SEQ ID NO: 39819 - DNA, 459 bp, Homo sapiens
aagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatat

SEQ ID NO: 39820 - DNA, 391 bp, Homo sapiens
  misc_feature 7: n = A,T,C or G
gaaagancttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcaagtgcctgtttatgaac

SEQ ID NO: 39821 - DNA, 146 bp, Homo sapiens
gcagctaggaataatggaataggaccgcggttctattttgttggttttcggaactgaggcattgaggcagccagcgcaggggcttctgctgagggggcaggcggagcttgaggaaaccgcagataagtttttttctctttgaaaga

SEQ ID NO: 39822 - DNA, 151 bp, Homo sapiens
  misc_feature 29, 48, 49, 68, 115, 127: n = A,T,C or G
gggactgcatgctactgtctagagctggnctcaatggatctagaactnnatcgccctctgatcgccgntcacctctgagacccaccttgctcataaacaaaatgcccatgttggncctctgccctgnacctgtgacattctggactatttc

SEQ ID NO: 39823 - DNA, 216 bp, Homo sapiens
  misc_feature 23: n = A,T,C or G
caaggtcttccatcaaatacagnatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtctt

SEQ ID NO: 39824 - DNA, 112 bp, Homo sapiens
tgcggcggctcatgcctataatcccagcactttgggaggctgaggaaggaggatcatttgggcccaggagtttgagaccagcctcggcaacatagcaagaccctcatctcta

SEQ ID NO: 39825 - DNA, 473 bp, Homo sapiens
attgtccttttatccctcccacaggtagtcactgagttctaataccacagagtcttttgactttcttttgagccttatgtaattagaatcacaaaagatgtattcttttgcctgacttttatacttagtattgtttttgaaattcatcttgtgtgtaactgcgatttgttcattttcattgcttagtgaattattccaaagttggatatacctggttaaccaccacccgaatgaaaaaaacagtttttggccgggcacgatggctcacgcctgttatcccagcactttgggaggctgaagcgtgcggattacgaggtcaggagatcaagaccatcctggctaacacggtgaaaccccgtctctactaaaaatacaaaaaattagctgggcgtggtgacgggcccctgtagtcccagctactcaggaggctgaggcaggacacctgtaatcccagctacttgagatgctgaaac

SEQ ID NO: 39826 - DNA, 467 bp, Homo sapiens
gacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtatttttgaat

SEQ ID NO: 39827 - DNA, 471 bp, Homo sapiens
attttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatct

SEQ ID NO: 39828 - DNA, 387 bp, Homo sapiens
aagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttattgtagtg

SEQ ID NO: 39829 - DNA, 420 bp, Homo sapiens
agccccaccacaaccaagatatagaacagttccttcacaccccaaatttcaccctgtgaggtcagttcctctctcgatttcagaccctgacaaccaccgggactgttttctgtccctagagccttgccgtttccagagtgtcaaaaacagactcatacagtgtgtagcctactcagtctggcttccttccctaagcttcctgcatgtgagcttcctccatgttgcaggtgtcagcagttctttccttttcatcgctgagtagtattctattgcgtggacgtaccacggtttatcattcaccagctgctcgggaggctgaggtgggagaatcgtttgaaccccagaggcggaggttgcagtgagctggagattgcaccgttgcactccagcctgggtaacaagagtgaaactccgtcacac

SEQ ID NO: 39830 - DNA, 235 bp, Homo sapiens
atcccattcatgagggctctaccgtcatgatctaatcccctccctctaaggtcccacctgcaaatatcatcatatgggtgttacatttcaacagctgaattttggggggcactatcattcagtctacagcactgtgaaatccctaatatcgagttttctttttaatttttgttttgttttgttttgagacagagtctcgctttccagccagggcgacagagtgagactccatctc

SEQ ID NO: 39831 - DNA, 260 bp, Homo sapiens
  misc_feature 7, 8, 23: n = A,T,C or G
atagacnnttagactgattcccntttctagcaggtacctaaaacaataaataaaaagacttcctttaattacctaaaaatccctagggtttttactataagagaataaaatttgaaagcaaactaaaagagaagtttgaaatatatatgacaaatgcctaatactctgattatatgatgagtacttataaataaaaaatttgtagttcatagaagaaatacaaatagctcaaaatttataaatgattcaatcttaagagt

SEQ ID NO: 39832 - DNA, 200 bp, Homo sapiens
  misc_feature 5, 9, 28, 34, 40, 41, 49, 97, 154: n = A,T,C or G
tggcnaacntagtgaccacccccttccntctacntaaaannacaaaaanttggtggggcgtggtggcgcatgcctgtagtcccaggtacttcaagangctgaggcaggagaaatcgcctgaacccgggaggcagatgttgcagtgaaccaagantgtgccattgccttccagcctgggcgacaaagcaagagtccgtctc

SEQ ID NO: 39833 - DNA, 493 bp, Homo sapiens
  misc_feature 3, 10, 26, 34, 35, 109: n = A,T,C or G
aanctcggcnttttggccgggcaganccaggacnngaagttgatgctactctgaagtctctcaacaaccagattgagacccttcttactcctgaaggctctagaaagancccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgttagaaggagtgacttccaaggaaatggctacccaacttgccttcatgcgcctgctggccaactatgcctctcagaacatcacctaccactgcaagaacagcattgcatacatggatgagggagactggcaac

SEQ ID NO: 39834 - DNA, 498 bp, Homo sapiens
  misc_feature 5, 16: n = A,T,C or G
tgaanaatttcctacntctctgttttagttggagatttcttcctggagtacagtttgctttcagggcccttgaactcaccccttctccacttttgccataaggatagctgcaccattccttaatttatggcaaaccacaaagtgagtggcctagtatcacttgctccagtgttatgagcacccaggagtagttaaaaggtagtagctatataaaatacctttctaggttatgtcaggtagaagctccaagttctatgttttgattctctctgtccagagtcagagaagcattccttccctacttccaaatccaaaatattggcttcctccaaggtatttctcattgaaatcttatccctggaaaggcagcacatggacatattctgctaattgccatttgtctgacagcaatgaaatttcaaacgtcatccagtcttgaaatctgtcccttgcccagacctgtttcaactttttcactctcccctattctgactgact

SEQ ID NO: 39835 - DNA, 424 bp, Homo sapiens
  misc_feature 400, 407, 408: n = A,T,C or G
cgggtcttacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttgggtttttgttttagtttttgggttgcgttgccttttttttttttagnggggggnnggccccatgaaggggg

SEQ ID NO: 39836 - DNA, 471 bp, Homo sapiens
attgtgatatagaggcatgagcctgaaataccaatttgtccccagactgataggtaaacagcaaataggaaagccttcttcttccctctcatccctgcattcccaaatatttggggctctatccaacagcctggatctgcagcaaacatttgcctctgactcaattgaccccttcatggcgaatcttacatccacattggataactctactggctcaatctatgaacaattttcaaaattgaggaaataaggcccttttccattcttaaataggctggcctaaatattcttgggagcttcatggagagtgtcatgccctggcttattcgcaaaggtggcaatggccttcagactcagctaagacaaacattggcacatgcaggtggccatcagatgttaatgtttatcttgttcctctgtattgctgttatctttcagggaaatctaggaatagcagaaagatgaatcttt

SEQ ID NO: 39837 - DNA, 479 bp, Homo sapiens
gagtgatgaaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagcctttcagtccactggcgagtctgaatggaaggatactaattatacactcaacacagattccttggactgggccttatatgaccacctaatggatttccttgccga

SEQ ID NO: 39838 - DNA, 245 bp, Homo sapiens
  misc_feature 4, 22, 29, 30, 34, 40, 44, 47, 50, 56, 57, 60, 70, 76: n = A,T,C or G
accnagcactcttgtgccctanactgaanngccnttcccntccnctngcngtggannacnacttttttcngttccngttttgtgcctcttttcctccaccttgtacttctggaatctttgtctccttttcacctgcccagtcacgaactttcagtggtctcttcttgtgcttgcatcaaacaagttatttttcttttacttgagtcatttccatcaatatggaaatgcttgttattttctcccat

SEQ ID NO: 39839 - DNA, 469 bp, Homo sapiens
  misc_feature 2, 9, 32, 105: n = A,T,C or G
cnacggctntttggtgtgttttaaacttggcnctcttgcttacctggacactaaaaacaagtcccagagaacaaggacaatgtcttcttcttcgtgtgtttctcntggggttttgtagtttgtaggttgaaatctttcctgcataaaagaagggacaaatacattaattagaagtacttaccatgtgatagctcttgtgctagatcttgggatacagagatgagagaacatttttctcaagaagcttatagtctaatgcagtggttctcaaagtatggtttgtaggcctctggtggtctctaagatcctttcaggtcaaagcttttataataatactaagacttctttggggggctttatttattggtgcagacatttatactaatggcacaaaagcaatggtgatgtgttagaactgctggtgacttaaaccatatcaagaaactgataccaaaccctattgattctt

SEQ ID NO: 39840 - DNA, 473 bp, Homo sapiens
  misc_feature 9, 114, 135, 247, 337, 369: n = A,T,C or G
gaagaaaanatctagaaactgagttgtggagctgactctaatcaaatgtgatgattggaattagaccctttggcctttgaactttcataggaaaaatgacccaacatttcttancatgagctacctcatctctanaagctgggatggacttactattcttgtttatattttagatactgaaaggtgctatgcttctgttattattccaagactggagataggcagggctaaaaaggtattattattnttcctttaatgatggtgctaaaattcttcctataaaattccttaaaaataaagatggtttaatcactaccattgtgaaaacataactgtnagacttcccgtttctgaaagaaagagcatcgntccaatgcttgttcactgttcctctgtcatactgtatctggaatgctttgtaatacttgcatgcttcttagaccagaacatgtaggtccccttgtgtctcaata

SEQ ID NO: 39841 - DNA, 499 bp, Homo sapiens
  misc_feature 13: n = A,T,C or G
tctggccgggganctgacttaccttctgtcttcttgaggagtgagagtggaaggaaatgtttggtgtgggttcctgggccaggaggttttctccctggggttcccattccagaacgctgtcctcattcatggttgctgttcacctttcaccactccctgcattatttcatgtgggcgaggaacgagtgtggaaatggggattggggactaatagacttgtctcttcaccaggtctccccacacttccagtccagaaaacactttttagttatagaaatggatatatccggctgggtgcagtggctcatgcctataatcccagcactttaggaggccgaggcaggcagatcacgaggtcaggagttcgagaccagcctggccaacatggtgaaaccccatctctactaaaaatacaaaaattagctgggcgtggtgggcaggcacctgtaatcccagctactcgggaggctgaagcaggagaatctcttgaatccggaag

SEQ ID NO: 39842 - DNA, 474 bp, Homo sapiens
atttcagcctagtgtagcctgagggcatagcttagaaatagaaagcgatataaccataaaaaataaccaagaaagttaggtttcttggttatttgctgtataagtgatttgctgtaatgggatgctttgagagctgttttcattttctattgatgctgtgacaaatcatcaagaatgtagtagttttcttacatttatgaaggtcagaagtgctaaaatgaaggtgtcggcaggtctgcattccttctagatggaagctgaaaagaagaatccatttcttttattttaaacttttattttaagttcaggggtacatgtacagttttgttacataggtaaacttgtgtcatgggggtttgttgtacagattatttcatcacccaggtgttaagcatagtacccactagttatttttcctgatcttctccctccttccatcctccatcctctgataggcatcagtgtgtcttgttc

SEQ ID NO: 39843 - DNA, 489 bp, Homo sapiens
  misc_feature 3: n = A,T,C or G
ganctgccgtgggtgtcggggcacagcttgtcctgagtcagaccctaatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggct

SEQ ID NO: 39844 - DNA, 365 bp, Homo sapiens
cctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttatttta

SEQ ID NO: 39845 - DNA, 242 bp, Homo sapiens
  misc_feature 1, 19, 43: n = A,T,C or G
ngccgggggcaggaggatnacttaagcctaggagttcaagacnagcctgggcaacatggagtaaaaccccatctctacaaaaaatacaaaaattagctgggtatggtaatgtgtgcctgtagtcccagctacttgggaggctgaggtaggtgaattgcttgagctgaggaggcagaaattgcagtgagccgagactgtgccactacactccggcctgggcaacaagtgagactctgtctcga

SEQ ID NO: 39846 - DNA, 473 bp, Homo sapiens
gtctgtatgcgtgcctgtctgtgtgcgggtgtgtgcatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatccacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaagggagatggaatgtgtctggtaaccccaaatggagtacaagtagcctttgttttcctgcataaatgga

SEQ ID NO: 39847 - DNA, 118 bp, Homo sapiens
atccagctaaactaagtcttcctaaatgaaggagaaatgagatcctttacagacaagcaaattctgaggtaattcattaccaccacatctgccttacaagagattttagaaaggagga

SEQ ID NO: 39848 - DNA, 163 bp, Homo sapiens
ctatatgtctatatttacatctataccacacatatttttgttctctagaagtttgatttgaatatacacacacacacatacacatgtgtgtgagaattaacagcagattagacattgcagaaaaaaattagttagcttgaagatatagcaatagaaactatct

SEQ ID NO: 39849 - DNA, 156 bp, Homo sapiens
gggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatcgt

SEQ ID NO: 39850 - DNA, 174 bp, Homo sapiens
  misc_feature 2, 8, 9, 22, 26: n = A,T,C or G
anaattcnntagaacttgcacntttntttgtatttagtattagtaacgtgagtggaatacaaccctcatttcttagagctggatttctccctgctgaataagtaattttttttgctcttcagagggtttgaattttggatatttagaaacaaagtatttctggtgagttttaca

SEQ ID NO: 39851 - DNA, 357 bp, Homo sapiens
caactccaaaggaaccctcaaaacctacaaatacatggaaattaaataatctgcttctgaatgatcattgggtaaacaatgaaatcaatatggaaattaaaaaattatttgaactgaataataatagtgacacaacctaccaaaacctttggggtacagcaaaagcagtgctaagaggacagttcataacattaaatgcctacatcaaaaagtctgaaagagcacaaatagacagtctagggtcacacctgatgtaactggagaaacaagaacaacccaaacccaatcccaggagaaaaaaagaaataacaaagatcaggagcagaatgaaatgaaattgaaacaaacaaatacaat

SEQ ID NO: 39852 - DNA, 466 bp, Homo sapiens
gtggggaagcgggggtgtctgattgacagttctgtcttgtggtctggcatggccctgtttgtagtgctgattgcaggggttgacttgctacagattgacataagctctacatatattaattccagaattctttgcattttatctcaattatattttattaaatatctatacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttagactttgctcctgtattgtgtttttattttaactctgtaaggctttaaatctcttccatagagattgca

SEQ ID NO: 39853 - DNA, 495 bp, Homo sapiens
  misc_feature 2, 17: n = A,T,C or G
cncccgggaattcggcnttatggccgaggattgttgcaaggatagtgaagccttgggcaggctgctggggcccttggaaggtcgagataaagagaaacaatacacatttatagttctaagaggttatgcattatagaacaccttctccagtttaatataagaataagcagtctctgttctctaaaagccagaaggcttatgggggagaccaacacactaatttagggcttcagcagaaatttctgtaaagtgaggtgtgcctaccttccctttcatgtttccctaaatgatatgtcccctaccctgcagattgatatctgatgatgcaaaacaattaaacaaaaccctctctttgctgacctgtgaaatctgaagtttttacagtgaaaagtgctaaataaatgttcaaagttgacatagtatatttatcactttacacctaatggtctttctatgatgaattgacttaagtgctttgtactggagaatcagcac

SEQ ID NO: 39854 - DNA, 306 bp, Homo sapiens
gaacaacaccataggccaattaaacctaacagctgtatacagaaacacaccacacaatgaaagcggagttcacataaaacattctccaggctataaatatttacagctataatatattctcggtaaatgttaaaagattgaatttatgtttagtatcttatccaagtacagtggagtgaagatggaaataaataacagaaggaaaatgaaaattctcaaataaatgaaaattaaacaacatgctcttaaactaccaatgggtcaaaaaaagtcattagaaaaattagaatatacttggaaataaat

SEQ ID NO: 39855 - DNA, 473 bp, Homo sapiens
gtctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatca

SEQ ID NO: 39856 - DNA, 426 bp, Homo sapiens
  misc_feature 121, 415, 421: n = A,T,C or G
atacaagcagatgtggcagtatttgaagccgtgtccagcccaccgcctgccgacttgtgtcatgccctacgttggtataatcacatcaagtcttacgaaaaggaaaaggccagcctgccangagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgtcaagtcttccatcttactagatgtgaaaccttgggatgatgagacagatatggcgaaattagaggagtgcgtcagaagcattcaagcagacngcttantctgg

SEQ ID NO: 39857 - DNA, 386 bp, Homo sapiens
gaaaggaaaaccggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaata

SEQ ID NO: 39858 - DNA, 481 bp, Homo sapiens
  misc_feature 459, 460: n = A,T,C or G
gaagactcagtgggagaaggtggtatttaatttgagcgtttaaaaatgggtaggattttcacgagcagagattgagggagcaggatgaaaggggaggaagagtttttccaggctgcaaaccagcggagcagggtccaaaaggggaaagtgcagttgtcttattttctcctgcgcctgcgatctgcgggcaggtaagagccagtgggtcttctcccatctgaacctgtttgtgcccttgaggctctacttgaatccttatggctcctctgattttctgcaccatcagccagactgaggagaaatggctgttgatagctttaaagtgttaacactccgaaaagtatctctatattaactggtaagagcttaaagccttgaaccaaaagcgttagagttctaatagcttaaaggagaaaagccggtattgggttttaacaatatatttggtttatcaaatgnnggaaagccattgataaaattc

SEQ ID NO: 39859 - DNA, 231 bp, Homo sapiens
gtatgacaaacacacagccaacatcatatggaatggggaaaagttgaaagcattcttcctgacaactggaacaagacaaggatgtccactttcaccacttctattcaacatagtgaatcagacccataacaatcagacaagagaaagaaataaagggcatccaagaggaagtcaaactatcgctgtttgctgatgatatgattatatacctagaaaactctaaagattttt

SEQ ID NO: 39860 - DNA, 297 bp, Homo sapiens
aggaaattctatttttgttaattgtataaatatttttaatatagataagtataatgtgataaataaaagattttcaggcataaaaatgtgtcactgtaggacaaggtttcttaaccttatcaatagcactattgacattttgagtcagataattcttgttcttgggggctatcttcagctttgtaggatgtttaatagcatctgtggttcactggatgccagtagcacccttccttaagttgtgacaatcaaaaaatgtctccagacattgtcaaatgtccccctgataggtaaaat

SEQ ID NO: 39861 - DNA, 130 bp, Homo sapiens
  misc_feature 3, 12, 24: n = A,T,C or G
atnaaccttccntctacacttatnatcttcacaattctaattctactgactatcctagaaatcgctgtcgccttaatccaagcctacgttttcacacttctagtaagcctctacctgcacgacaacacat

SEQ ID NO: 39862 - DNA, 427 bp, Homo sapiens
catctgtaggtaccaacatcaaagacaaaaggtagataaaaccgcaaagatggggagaaaccagagcagaaatgttgaaaattctaaaaaccagagcacctcttctcctccaaaggatcgcagctccttgccagcaatggaacaaagctggatggagaaggactttgacaagttgacagaagtgggcttcaaaaggtcagtaataacaaacttctctgagctaaaggagcatgttcaaacccatcgcaaggaagctaaaaaccttgaaaaaaggctagatgaatggataactataataaacagtgtagagaagaccttaaatgacctgacggagctgaaaaccatggcacgagagcttcgtgacacatgcacaagcttcaatagctgattcgatcaagtggaagaaagggtatcaagtgattgaaga

SEQ ID NO: 39863 - DNA, 428 bp, Homo sapiens
atgaggttggagttcgaaagaagaagcaagcgctggcctggccttgaaagaaccgaagcctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttacgccttttatttttaatttaatcccgttcaattatttaattgttatacattgacattaactgctgtattttgactttgttcaataattttgttctttcagggctagaaataaacttttt

SEQ ID NO: 39864 - DNA, 483 bp, Homo sapiens
  misc_feature 2, 355: n = A,T,C or G
anaactaaacagaggaagtcttcagaagacctcgctttaaaacaaatttgtgcaaacactgctagagtccttttgaagctcaagcattttcactttgtttcttacactgtgtaccttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatggggnggttttcttttccgggtttggtggaaagtaatttgagaactttaaaggttgtctttttaactgctggcaaaatgttgattttttaatattagataaaacgagtaaacgaaattccccagaaattagta

SEQ ID NO: 39865 - DNA, 466 bp, Homo sapiens
catattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatatttgatgtctttgactgttggaaaccttgcagagcaagaatttgtaaccattgcacgtcactaccgtgtgcctg

SEQ ID NO: 39866 - DNA, 454 bp, Homo sapiens
catataacacatagtgtgggcttgtctactataccctgagacgataagattcttgaggactgggtcattatttataattacagatataaatttaaatctaaataaaactcactgcaatttttttcatagaagatacttcataaatgttgctgatatgaaaaattgaatctatgcccattgtttaattatcttcattgtcactgactaacttagtcttaccagcttaatacagtgtttatgaattatctcacagttcctgtggaccaggaatgtgggcacagcttagctggtacctctggctctagatctctcatgatgttgcagtcaagctgtcggctacaactgcagtcattcacagcccaactggggctgaagaggccacttccagattcagcctccacagagctgccttatgatttgggaaagctgtcttcctcatgaacaatcaatccta

SEQ ID NO: 39867 - DNA, 461 bp, Homo sapiens
  misc_feature 439: n = A,T,C or G
cccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgattagattggggggtgggnggggggtttattttctgaaagt

SEQ ID NO: 39868 - DNA, 418 bp, Homo sapiens
  misc_feature 13: n = A,T,C or G
gacaaccttagcnaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacacta

SEQ ID NO: 39869 - DNA, 367 bp, Homo sapiens
gtccttagactaattatctctaatatattggtgttctgtaattttctttcaattgtgaagtatctacaggctgttgacaatcagctaaagaaaaaagcaagactgtttaaagacagtaacagggccaggcgcggtggctcacgtctgtaatcccagtactttgggaggccgaggtgggcaaatcacctgaggtcaggagttcaagaccagcctaggcaacatggtgaaaccctttctctattaaaaatacaagtaggccgggcttggtggctcatgcctgtaatcccagcactttgggaggccgagacaggcggatcacgaggtcaggagatcgagaccatggtgaaaccttgtctctactaaaaat

SEQ ID NO: 39870 - DNA, 463 bp, Homo sapiens
  misc_feature 463: n = A,T,C or G
gctttttttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggn

SEQ ID NO: 39871 - DNA, 468 bp, Homo sapiens
aatgtaagaagtatgacaagtgctgtcccgattatgagagtttctgtgcagaagtgcataatcccacatcaccaccatcttcaaagaaagcacctccaccttcaggagcatctcaaaccatcaaatcaacaaccaaacgttcacccaaaccaccaaacaagaagaagactaagaaagttatagaatcagaggaaataacagaagaacattctgtttctgaaaatcaagagtcctcctcctcctcctcctcttcctcttcttcttcaacaatttggaaaatcaagtcttccaaaaattcagctgctaatagagaattacagaagaaactcaaagtaaaagataacaagaagaacagaactaaaaagaaacctacccccaaaccaccagttgtagatgaagctggaagtggattggacaatggtgacttcaaggtcacaactcctgacacgtctaccacccaacacaata

SEQ ID NO: 39872 - DNA, 261 bp, Homo sapiens
  misc_feature 187, 189, 218, 229, 251: n = A,T,C or G
gaagaattaggtcatccaaaatatgtgtggggtgtgaagttttgttttctgcacaaagacttgtcatgagtctaaacatttctctctcaagtaatttacaatttaattaccttgtgttatgttccctcaggaaggggaggagaagggaaaggaagaaaaggcaaaaaaaaaaaagttttaaaaatgngngctgcattcaggatttaaatttcaccttntaaagtttttnttacagcgtcctcctcccctcnttgggccatg

SEQ ID NO: 39873 - DNA, 417 bp, Homo sapiens
  misc_feature 69, 164, 172, 175, 208, 255: n = A,T,C or G
gtgaaaaagcttgtggtgaaggggggcaaaaaaaaaagaagcaagttctgaagttcactcttgattgcncccaccctgtagaagatggaatcatggatgctgccaattttgagcagtttttgcaagaaaggatcaaagtgaacggaaaagctgggaaccttggngggggggnggngaccatcgaaaggagcaagagcaagatcaccgngacatccgaggtatttgaaatatctcaccaaaaaatatttgaagaanaataatctacgtgactggttgcgcgtagttgctaacagcaaagagagttacgaattacgttacttccagattaaccaggacgaagaagagggaggaagacgaggattaaatttcatttatctggaaaattttgtattgagttcttgaataaaacttgggaac

SEQ ID NO: 39874 - DNA, 143 bp, Homo sapiens
agtggccactgtagtagacagggggatcagaagaggcctcttttgggaggtgacagttgagcctgataaccagaaagatgagaaggcaccagttgtgggaagatctgggagtggaacattctaatctaagcattgttacatac

SEQ ID NO: 39875 - DNA, 450 bp, Homo sapiens
  misc_feature 356: n = A,T,C or G
attgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgngggggtttctctctcccctcccttggtcttaattcttacatgcaggaacactcagcagacacacgtatgcgaagggccagagaagccagaccca

SEQ ID NO: 39876 - DNA, 124 bp, Homo sapiens
ctcccttcaggtgccgggcgcaggaactgtgtgtgtcctacacaatggtgctattctgtgtcaaacacctctgtattttttaaaacatcaattgatattaaaaatgaaaagattattggaaagt

SEQ ID NO: 39877 - DNA, 287 bp, Homo sapiens
gaggcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggaac

SEQ ID NO: 39878 - DNA, 476 bp, Homo sapiens
  misc_feature 16: n = A,T,C or G
gatgaccctgacaagncctcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagttctctcaaattttgccagtggaaacccttcaagtacttcatggcatggcctcatttgtctttttggtgcaacagggttgttacaagttgagttgaaaacaagaaaaacttgcttttggcgccatcaaaaaggaaggccagatactttcctttctacaattgaagccatttactactttctggtagactaccatactgatatattaaaagagaaatacagagggcaatatgacaatcttttatttttctattcttttatgtacccagttgataaagaatgccaaatgctctggagataaggaaacaggaaaac

SEQ ID NO: 39879 - DNA, 469 bp, Homo sapiens
  misc_feature 454: n = A,T,C or G
actcttatgggttgaatcgtgttttcttaaaatttgtatgttgaagttataattcccagtacctcagaatgtgattttatctggagataggatgtttacagaggtaatccagttaaaatgaggtcgccactgtgagtcctaattcaatatgactggtgtccttattaaaagggacacagagacacaaatggaaggaagacagtgtgaacagacacagggagaagatggccatctacaagccaaggagagggtcctggaataggtctttgccttacatgccccagaaggaaccgactatgccaacaccttgcttttggacttctaaactgcacaatagtgagacagttcatttctgttttttaagccaaccagtttatggtgctttatatggcagtgttagtaatccaatacagggagattctgagcagaggaaaccagagaaagaaagcctggntataggtttagaagg

SEQ ID NO: 39880 - DNA, 250 bp, Homo sapiens
  misc_feature 250: n = A,T,C or G
gtgtgaaattttaaaacaggttacattcatctatagtggtagagatctgaatagtggttaccttttgctggggctgttgcctgggaagaagcttgagggagccttctggggagctggaagtgttgaacatcttgatttgggtggtagttaccaaagatatacatattttaagaattcacccatctgtacacttaagatttatgtaaaatatactttaataaagacataacaaaactcaagggcaagtgcn

SEQ ID NO: 39881 - DNA, 269 bp, Homo sapiens
acccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 39882 - DNA, 352 bp, Homo sapiens
cgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctccgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatg

SEQ ID NO: 39883 - DNA, 148 bp, Homo sapiens
  misc_feature 70, 128, 136: n = A,T,C or G
acctcaaggatggctagaaatcttatatccgaccgcttacttcctgaacacagtggcatggaaacacatnatcatgatgtaatcatgagcctgtacataagccagctactctgttgggttcaggttgnaacctgantgtctgcagaat

SEQ ID NO: 39884 - DNA, 251 bp, Homo sapiens
  misc_feature 243: n = A,T,C or G
gagaacgggtcacgtgagcgcctcgcctggatgtgagtttcagccagatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaaggataccttcctttttggggaaaggtttggggtntttttggg

SEQ ID NO: 39885 - DNA, 383 bp, Homo sapiens
  misc_feature 46, 153, 154, 222: n = A,T,C or G
cacccagggaaattcggcgcttatggcgcgggattctcaacaagtnattccaagtcagcccgttaaggagaaagaaattaaggttagcgaatcatgtacaagctgagtgtgaaagtacgaaatcacctacaccagagagccattttggtattnngcctttaaataaaaagcctcctttatctggctgtgcagccttgctctgtggcttttcccaacacaatnagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatat

SEQ ID NO: 39886 - DNA, 470 bp, Homo sapiens
agaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttctttttaactgaaagctgaatccttc

SEQ ID NO: 39887 - DNA, 430 bp, Homo sapiens
  misc_feature 1, 29: n = A,T,C or G
natggacatgccatttaaaggtcccaggnagtattgatttccaactggaatgcaggaagagtctaagagtaactgaaatttggaaacactgctagttatttttaagactactctttcttgaaatggatcagaaccaatagaacaaaccacaggttgtgatagatttatgcactgaggaatataggaagagaaagtaaaaactatgggcaaggattttcataaactgcatcataaattgatttggtgggccccaaggagaacataaacactatgcccaaggactcagggatttgacttttgtttagatccattttataggcaatctgtaaaaggaaaaaagggcaaaaataatattagttatctcataaagttgtttaaaaatcaagtgatgagaataatctatttaaaatacttatcacagtgcctacac

SEQ ID NO: 39888 - DNA, 428 bp, Homo sapiens
aagaaatgcatttgtgtgttccttataacatcttacttaaaattcaaaggtaaagccagacactgtggcatatgcctgtagtcccagctgttcaggaagctgaggcaggagaatcacttgagccctggagtttgaggctgttgtgcactattatcatggtcgtgaatagtcactgcactgcagcctgggaaacacagcaagaccctgtctcttaaaaaaatgtttctcggtagttggtatagtggaacaagctgactacaaggacctttgtaatgctagagttgggagaatcagggtagcagtcttgtgctgactttaccattattgttaccaagggtctaaagaagctttttatccaatctgccacaaccacacacacccacaatgtaatacttaactgtaaggcagaattgggatgttacatttat

SEQ ID NO: 39889 - DNA, 144 bp, Homo sapiens
aatgtcattgctaaaaaataaataaaagctagatactggaaacctaactgcaatgtggatgttttacccacatgacttattatgcataaagccaaatttccagtttaagtaattgcctacaataaaaagaaattttgcctgcga

SEQ ID NO: 39890 - DNA, 213 bp, Homo sapiens
cccaggagttcgagacaagcctgggcaacatagtgggaactcatctctgcaaaaaatttaaaaactagctaggtatggtgatgcacacctgtggtcccagctactcaggagactgaggtgggaggatcacttcggcccagaacatcaaggctgcagtgagctatgattatgccactgcaccccagactgggtgacaaagtgagactgtgtctc

SEQ ID NO: 39891 - DNA, 464 bp, Homo sapiens
gacaactcggtggtggccactgcgcagaccagacttcgctcgtactcgtgcgcctcgcttcgcttttcctccgcaaccatgtctgacaaacccgatatggctgagatcgaggaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagt

SEQ ID NO: 39892 - DNA, 472 bp, Homo sapiens
  misc_feature 424: n = A,T,C or G
agaaaaaaagattcttcctaattaacataagtggttcctaacgagagcaatttttccacccaaaagtcatttggcaacatctacagacaattttgattgtcacactgggtcgggtaggaaggtatgctgcagacatttggtgggtagaggccatggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcaagnagtggggctggatcaagggcaaaaactggtcattaagtcatctgacat

SEQ ID NO: 39893 - DNA, 472 bp, Homo sapiens
gagagtgttatttatccgtagcctggccaatttcaggcaagtaattgcaggatgaggagtaattccagtccctgtacctgctggtgagatcactgaagaactcactcagcgtttgtagcacacagaatggccacggttacatacctgagtgcattcacagtataaccaagcccaaatcctcggccaaatccctaagggaatctgggttttaccttgcaaactttggctgctaggcacagttacagagccttgttatgctttaggctctcaataaaaatgtttgccctgggttattacaaagactttcttggtacagaaattcagacaagatcacgaagcacagggtgaaaatacaggaatgagcagaaggagccaattctaaagttttctgaagtcagctcatgccttcataaatagtgagcctccttggtcgctcactgaaacaaaaaagatggacatgtaatttacctag

SEQ ID NO: 39894 - DNA, 439 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgccacagaaccctctaaatccccttgtaaatttaactgttagtccaaagaggaacagctctttggacactaggaaaaaaccttgtagagagagt

SEQ ID NO: 39895 - DNA, 471 bp, Homo sapiens
  misc_feature 435, 450: n = A,T,C or G
catcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttanatacaaacttatttncatgtttctgaatcttctttg

SEQ ID NO: 39896 - DNA, 479 bp, Homo sapiens
  misc_feature 5: n = A,T,C or G
acccngggaattcggccttacggccttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactccgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacg

SEQ ID NO: 39897 - DNA, 459 bp, Homo sapiens
cgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccca

SEQ ID NO: 39898 - DNA, 301 bp, Homo sapiens
aatctaaattaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgc

SEQ ID NO: 39899 - DNA, 466 bp, Homo sapiens
gaatgggggaggggacagtggacagagctttgatgtccacttgtgtgcacagagctctttaaagctctgtgttagagcaggaggtgagaagagaatgggtggtcttagggctcaggaattagggatcagctctccctttgctgtatgaacctctgaagaatctgagaatttaaatataaatcttgcctgccaggcttttatgatgatgtatttgtcaaaacagaagtatagaatatcttttatataacagtttgttttcttgatttacagcgtttaaatatttaggtgtgtggtgggtgggcctccatttggacttttgccccaggccttgcaagctagggcacaggcctgaagctacgtaaatgcacctgagagagatttttagtttgtaaaggacagattttaaagaaatttgttcaagagaagaaagcgaagtttcctggctcatgggaacatctgtagacat

SEQ ID NO: 39900 - DNA, 451 bp, Homo sapiens
atgcacactccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccaggagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagcccttcttaaatgacaaaatgc

SEQ ID NO: 39901 - DNA, 474 bp, Homo sapiens
  misc_feature 468: n = A,T,C or G
tagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggngttggt

SEQ ID NO: 39902 - DNA, 473 bp, Homo sapiens
cacttgattgagagaaggattggagaggagctaataagtgaagttttgtttttgccatttaggaggccacagatgaaaaactaaatgcaacactgtcgcatatgttgctgtgcaacaaacaattaaatagaaaatgagatgcatataaaaaagccttttcttacagaaggcaggtacactctcaaatcagaaaccatgggatatttcgaaatttagaacagggacaatgtcgagagtattttaaatataggcagcaggtagaacatccaaaagttgatggacacatgctccagttacttacatgcaacaggaaagtgtgaggctataggtggtctgcagaagggttgctaaggcttgttctacaacagatgataacagaggaggtggcagtgaatgaggaatgacaccagcctgccacatgtgccaaaagcaggatgcatgggtggcaaggtgggagaagataaaccacacca

SEQ ID NO: 39903 - DNA, 469 bp, Homo sapiens
atcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatccggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatg

SEQ ID NO: 39904 - DNA, 334 bp, Homo sapiens
  misc_feature 22: n = A,T,C or G
aatacatgtgtagttccaaagncacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttataga

SEQ ID NO: 39905 - DNA, 471 bp, Homo sapiens
aacagtagtacagatacctattactagaggagaagtaatggtgagaaacttcttggtgtgactccattattcacacaccattcttgtttgccctgacgtgttatgcaggtctggcttttatttgagatgtcctgaccttatataagagataggactgattcaagtttcaagcctaatgatgtaacacctctcagctggaagggagcatctctgagattgattcctacactgtgggagttccaagtatatattcatcacatataataaacttcctaagtcccagaatccctttcgccaccttttgctagcttttataggacagttttttagtaagttatttcttaatcagtgtcttatcatttccaggtagtaagtttagactcattaagcctttgaagttactggtgctattaagtgcatcattgctctgtgcattgaaggacagtgaagtggtggctgcttgtctgtgtg

SEQ ID NO: 39906 - DNA, 153 bp, Homo sapiens
cattttctttgataggtcagaattggaacatttaactattagtaaaaattgggattgtagtgtggttttacgtaagcaaacaactcttactctattttatttacaaaaattaataacaaaaataaatgcccaaggtagagggaattaaatact

SEQ ID NO: 39907 - DNA, 181 bp, Homo sapiens
agtttgagatagactgggcaacaactgagaccctgtctctacaaaaaatttattaaaaattagccaggtatggtagtgcacgctggctgaggtgggaggatcacttgagcctgggaagacttcagtgagccatggttgtgccactgccctctagcccaagcaacagagcaagaccctgtct

SEQ ID NO: 39908 - DNA, 185 bp, Homo sapiens
  misc_feature 5, 81, 105, 113, 134, 160: n = A,T,C or G
gaagngagtacatgaacggtgctaaaaatgaaaattctaacccaaggacatgacattcttagctggaacttaactattaangccttttccacacgcattaatagncccatttntctcttgccatttgtaagctntgcccattgccttattggcacatggntggacacggatctgctgggctctgc

SEQ ID NO: 39909 - DNA, 474 bp, Homo sapiens
atagatttaatgccatccccatcaagctaccaatgagtttcttcatagaactggaaaaaactactttaaagttcatatggaaccaaaaaagagccctcattgccaagacaatcctaaggcaaaagaacaaagctggaggcatcacgctacctgacttcaaactatactacaagtctacagtaaccaaaacagcatagtactggtaccaaaacagagatacagaccaatggaacagaacaaagccctcagaaatagtaccacacatctacaaccatctgatctttgacagacctgacaaaaacaagaaacggggaaaggattccatatttaataaatggtgctgggaaaattggctagccatatgtggaaagctgaaacgggatcccttccttacaccttataaaaaaattaattcaagaggggttaaagacttaaatcttagacttaaaaccataaaaactctagaagaaaagc

SEQ ID NO: 39910 - DNA, 470 bp, Homo sapiens
gagagatttgcttccagctcactcttgtgactattggcctgagatgtcagttgccacatgggactccccatagggcagctggattctctcagagcaggagggtacctaaaataacaccatggtcttttcgtaacctaatctcagaaatgacagccaatcactgttgctgcattctatttactggaagtgagtcactaagtccagcccacgtacaaagggaggagactgcacaaggaagcagtcattggacatcatcttagagaaggcccaccatggtaaatgtatttccttaaactgagtatataaaaatattattttaacatgtagtcagcatacaataattaccaatagatatttaataccttttactaagtctatggaatatagtgtgtattttacacttatagcacttctcaactcagatgttatattttcattggaaatacccgatctgtatttagatgtcatga

SEQ ID NO: 39911 - DNA, 283 bp, Homo sapiens
  misc_feature 283: n = A,T,C or G
atgatgaaattccctgcatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcggtttcattcagctctctatggaccagtaatctgataaataaccgagctcttctttggggatcaatatttattgacttgtagtaactgccaccaataaagcagtctttaccacan

SEQ ID NO: 39912 - DNA, 482 bp, Homo sapiens
attaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgttttt

SEQ ID NO: 39913 - DNA, 336 bp, Homo sapiens
actgaaatactttcttgccttggcttccaaaatgttacatttgcctggtttttctcctacctcactggctgctttttctcactcttatctgtatatttacctcatcttcctcttctttctcctcctcattcttattttcttccaccacgcccggctaattttttgtatttttagtagagacggggtttcacagtgttagccaggatggtctctatctcctgacctcgtgatccacctgcctcggcctcccaaagtgctgggattacaggcgtgagccactgtgcccggcctatgttggtgattattaatggtaaggaaaaattttagaaggtcctg

SEQ ID NO: 39914 - DNA, 343 bp, Homo sapiens
tcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactc

SEQ ID NO: 39915 - DNA, 314 bp, Homo sapiens
cacattggccaagttatcatgtccatccgcaccaagctgcagaacaaggagcatgtgattgaggccctgcgtagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgt

SEQ ID NO: 39916 - DNA, 159 bp, Homo sapiens
cagggtggaatagacagggatagaaactaaaattctttgagtgtgcctgttttatagaattactttgaaatcaggtatatgttttacttaattaaaaattaaaaaggaaatacaaatacaatctcttgaaagaaagaaaaaaaagggagagggttggag

SEQ ID NO: 39917 - DNA, 351 bp, Homo sapiens
atctttacttggaagttttctttttttaattgcagaagaaataagaattcactcctataaaaatttagatgatgcagctgggcgtggtggctcacgcctgtaatcccagcactttggaaggctgaggcgggtggatcacctcagctcgggagtttgagaccagccggactaacatggtgaaaccctgtctctacaaaaattagccgggcgtagtgatgcatgcctgtaatttccagcgactcgggaggctgaggcaggagaattgcttgaacccaggaggcataggttgcagtgagctgaagtcacaccatggcactccagcctgggcaacaagagcgaaactatgtctca

SEQ ID NO: 39918 - DNA, 405 bp, Homo sapiens
  misc_feature 354: n = A,T,C or G
atgtttttttttgtcttgcaaatgttctatgttttgagatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtattttttttttcttctggacagtntttaaaggatcttattcttatttcccagggaaattctgggctcccacaaag

SEQ ID NO: 39919 - DNA, 162 bp, Homo sapiens
atctcatgacatggtgaggcctaatgcagagccatgcagctgggcaccgtggctcacacctgtaatcctagcactttgggaggccaaggtgggagcgttgcttgaaaccaggagttaataaaggtcaacttgggaaatataatagtgagaccccatctctat

SEQ ID NO: 39920 - DNA, 466 bp, Homo sapiens
tcctccaagtagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgttcactctttgaatttcctggataagagttct

SEQ ID NO: 39921 - DNA, 135 bp, Homo sapiens
  misc_feature 26, 101: n = A,T,C or G
accaatgacataaatacatacaagcncacacaactaaaatgtcatgttattaacagttattaggttgtcatttaaaaataaagttcctttatatttctgtnccatcaggaaaactgaaggatatggggaatcatt

SEQ ID NO: 39922 - DNA, 214 bp, Homo sapiens
catgttcacttgttgttttaccccatctactctaacttcgttggaagccttgtctagagtatagtatgtgtttttacctttgcagtgaattgcatgtgctaattgtaaccacagctatttttatgttgacataactccaagtgttatattaaatgttctattttatattagctctaatcccttaagtaaattttaagaaataaattcttgttca

SEQ ID NO: 39923 - DNA, 413 bp, Homo sapiens
caccacatacattctttacatattatttatggctgcctgtgtgctacaacagcagcgctgagtcaccgtgacagagaccgtatgacctgcagagcctgagatatttactacatctgttccaccatagaaaaggtttgccaacccgactggctgcggtgactcatgcctgtaatcccagagctttgggggatcatctgaggtcagcagttcaagaccagcctggccaacatgttgaaaccctgtctctactgaaaatacaaaaattagctgggcgtggtgttgggtgcctgtaatcctagctactcaggaggctgaggcaggagaattgcttgaacccaagaggcggaggttgcagtgagccaagattgtaccattgcactccagcctgggtgacagagcaagactccgtctca

SEQ ID NO: 39924 - DNA, 284 bp, Homo sapiens
gcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttg

SEQ ID NO: 39925 - DNA, 123 bp, Homo sapiens
tgaccacgggtgacggggaatcagggttcgattccggagagggagcctgagaaacggctaccacatccaaggtaggcagcaggcgcgcaaattacccactcccgacccggggaggtagtgacg

SEQ ID NO: 39926 - DNA, 468 bp, Homo sapiens
  misc_feature 457: n = A,T,C or G
atgttttaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagccctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaaagagttctttatatattctggattctagacccttatcagatacatggtttgcaaatattttctcccattctgtgggttgnggttttcactt

SEQ ID NO: 39927 - DNA, 390 bp, Homo sapiens
ctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttg

SEQ ID NO: 39928 - DNA, 104 bp, Homo sapiens
gattaaatgagttaatatgtgtaaccatcttaacacctggtatatggaaggatcttaaatgttagctagtattatgatcttattaaccctattgaataattatt

SEQ ID NO: 39929 - DNA, 176 bp, Homo sapiens
  misc_feature 154, 160, 164: n = A,T,C or G
agaaggagatagctaaagatgtgtatttagagctcctggttgggtaacttcctgttatcgtgatcttagcagaagctgttcatcttggactttggtgttttacaaaatgagaaaagggcatgattcaattcagtctggaggtattgtttgtaancagtantttnggtgtttttgtt

SEQ ID NO: 39930 - DNA, 471 bp, Homo sapiens
tctgcttgtctttcttgagctttttggaaggataattctgataaggcactcaagaaacgcacaaccacagtgctttcttcaaatcatatgagaaatactatgcatagcaaggagatgcagagccgccaggaaaattttgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgta

SEQ ID NO: 39931 - DNA, 475 bp, Homo sapiens
ctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgaatgagcagacctttatgtattatgtgaatgatggcgtctatggatcatttaattgcatactctatgaccacgcacatgtaaagccccttctgcaaaagagacctgaaccagatgagaagtattattcatccagcatatggggaccaacatgtgatggcctcgatcggattgttgagcgctgtgacctgcctgaaatgcatgtgggtgattggat

SEQ ID NO: 39932 - DNA, 468 bp, Homo sapiens
caaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagagagctcagaaggctaaatgaatattatccctaatacctgccaccccact

SEQ ID NO: 39933 - DNA, 467 bp, Homo sapiens
gagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgttttttttctgctttgttttttcagtttgc

SEQ ID NO: 39934 - DNA, 474 bp, Homo sapiens
atatgaaaacagtgcagtaagttgaaaactcagtatctatggaattgataaatgttgatctggtgtagtatattttatcgcattttcttatattaaaaaatgtctgcatgattacattttatttcctttgtaatttacgtttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgtt

SEQ ID NO: 39935 - DNA, 220 bp, Homo sapiens; identical to SEQ ID NO: 38012
  misc_feature 218: n = A,T,C or G

SEQ ID NO: 39936 - DNA, 465 bp, Homo sapiens
  misc_feature 13: n = A,T,C or G
gattttaaaaatnttgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgct

SEQ ID NO: 39937 - DNA, 330 bp, Homo sapiens
ctaatacagaagggtatttcagaaatagggaacagcatgagcaaaggggctgtggcttattttggggatattctaggaacaacaagtggctggcttatggagggggctaaagatgaggacaaaaggtatgttgggtacctagaaagaacctttcatgccatgctaaggacaccttgttcttctgccatcagagactgcactagaattgttggcttgactgagttagactataagctccttgagggtaggtgatgggtgcaccaaaatctcggaaatccccactaaagaacttatccacgcaaccaaaaccacttgctcccaaaactattg

SEQ ID NO: 39938 - DNA, 146 bp, Homo sapiens
  misc_feature 145: n = A,T,C or G
cagtgacagaggtgttttggttttattgttatgtgggttttcttttgtatttttttttgtttgttttgtttttaaacattcaaaagcaattaatgatcagacataggagaaaccctgaatagaaacaaaacttttgaatgctggnt

SEQ ID NO: 39939 - DNA, 263 bp, Homo sapiens
catcacactacctgacttcaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatac

SEQ ID NO: 39940 - DNA, 259 bp, Homo sapiens
cacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaag

SEQ ID NO: 39941 - DNA, 302 bp, Homo sapiens
  misc_feature 246, 270: n = A,T,C or G
gattaataaaaaaggcagatattttcagaatttgaatttcagtttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgngacagtttgaaaccttcacagttntcctctgggggtaaatcaattcttcaaccctt

SEQ ID NO: 39942 - DNA, 324 bp, Homo sapiens
agcctagtagctccactgggttactagacccagaagagcaaaaacaatcactacagtttggctctcaggaatacccattcctaggggaagtgggagaacaccacatcaagggaacacccagtgggacaaaataatttaaacagtagtccttgaatcccagatcttccctctgacatagcctacccaaatgagaaagaaccagaaaaacaattctggtaatatgacaaaacaaggttatttaacacccccaaaatataccagctcaccagcaatggatgcaaaccaagatgaagtctatgaattgccagaaaaagaaatcaaaac

SEQ ID NO: 39943 - DNA, 468 bp, Homo sapiens
atcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtg

SEQ ID NO: 39944 - DNA, 470 bp, Homo sapiens
gttgaagtcttttatatcctcactgcttttctgtttagattttctgtcaattattgagaatggggtattgaaatctttaaatattgttgaattgttatttgttcttttaattctttcaggttttgctttatgtatttgagagtgctcttgttaggtatgtatagatttataattgctatgtggtcctgactgtatactgtactgttgggtttataacagaaaatacatgtacaagtcaatatcacttaagaaaatccttcatgaagcagtaaatatgtataaatatatatattttaaaagagaaagaggaaggaaggaaatggaattatatcgaaacaaagtttctgtattttaccgaattaaataagtataaatccagaatagattgtgatgagtcacaatggacattctaattgttacactaactgctaagaaaataagccagtaaaatatgcttaaaatcaatagag

SEQ ID NO: 39945 - DNA, 163 bp, Homo sapiens; identical to SEQ ID NO: 36062

SEQ ID NO: 39946 - DNA, 196 bp, Homo sapiens
gagctagtatgatgctttttagtatgcaaaatccctattcctatgaagagtcattattcaaaaaacactacttaaatttgtaagttttttatataaaagtagaatttaggagtaagaaatacggaattagccaaagcaggaagatcacttgagaaattcaagaccagcctgggcaacatagcaagaccctgtcttc

SEQ ID NO: 39947 - DNA, 151 bp, Homo sapiens
gtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgc

SEQ ID NO: 39948 - DNA, 476 bp, Homo sapiens
  misc_feature 181: n = A,T,C or G
gagaagggaggtggtcgccctccgtcgtggtctggcgtgtattccgagcgttggtgtctggcggtttccgagcgttggtgtctggcggtttctgaccgttggtgtctggcggtttccgaccgttggtgtctggcacgcgccaccctctcttgctttggttgcgccatgccgatgtaccagnacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccg

SEQ ID NO: 39949 - DNA, 151 bp, Homo sapiens
  misc_feature 21: n = A,T,C or G
cttgtcccgcctcatcccagnaagggaggatgggcgatgacagttgtttctatgccttctgacccagtttcccagtttataactttatgacaatgagtttctcaagcccaaggccttatcttcaccccacaaacaataaagcaaagtaaag

SEQ ID NO: 39950 - DNA, 299 bp, Homo sapiens
caaatgatttttgttcctttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatcttcctttagaaaactggtgttttctaaagaaacaggataggagtttagagaaggcaccaaagcattcactttggtttg

SEQ ID NO: 39951 - DNA, 395 bp, Homo sapiens
  misc_feature 4: n = A,T,C or G
agangcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtggccaatgcattaccttctgttccttatgatattctcattatttcatcatgactgaaagaagacacgagcgaatgatttaaatagaacttgattgttgagacgccttgctaga

SEQ ID NO: 39952 - DNA, 352 bp, Homo sapiens
  misc_feature 6, 33: n = A,T,C or G
gctttnagaattaacgaaagcagtgtcaagacngtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctaga

SEQ ID NO: 39953 - DNA, 237 bp, Homo sapiens
  misc_feature 31, 184, 237: n = A,T,C or G
ggaggcggaggggaagatggtcagtaggacntaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaaagaaagcctacaagnaagtacattcaaaagattacattgaaattcaatcaaaggggaaactttgaaan

SEQ ID NO: 39954 - DNA, 444 bp, Homo sapiens
gagagatggagatgaaattaaaatgtgacttctttggcatccacctttcgaacctaggccttccccactttactctaattcaatttagtagatgttggatggaaactaatacagttaaaaagaacttcatgtaatctcactaacattcttagaacatgatgctcaaggttttctggtcaaggatatttgcatttgcatttatagaatagttaagagccagaattctatgcatgtgagaagtccttgctttgagaatgacatttccaagctgtcaaaatctaatgtgctcaaagctcaaaccaaaattgctttttattctgtaaatattgaagagaaggcttagagtggcaccagtgaagttgctagccagggtactagcctactgagttggaatcagaaaaagtccatttgttgagtttaaattataatacaatccaagcctga

SEQ ID NO: 39955 - DNA, 412 bp, Homo sapiens
  misc_feature 6, 21, 32: n = A,T,C or G
gatctngtcttgttcccgaanaagtagaagcntcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagaaaatcaagtatattttaaaagaagggatgtgggatcaaggaggacagccttggcagtagtggcccttgaaccagcaacaatggatgcagtcattccagcaccaacaggatccaagccagattgattgggctgcattggcccaagcttggattgcccaaagagaagcttcaggacagcaaagcatggtagaacaaccaccagggatgatgccaaatggacaagatatgtctacaatg

SEQ ID NO: 39956 - DNA, 170 bp, Homo sapiens
  misc_feature 7, 32: n = A,T,C or G
aagagangttaggattttattgttcttatttncctttacagttctgcagttccatcacagtatttttttaaataactcaggtgtatgagaagaaattagaaaagaaaattaacttatgtggactgtaaatgttttatttgtaagattctataaataaagctatattctgt

SEQ ID NO: 39957 - DNA, 413 bp, Homo sapiens
attcatttaaggtacaaaattctttggacatctactatgctctgcacacaaggccagaaacagaagaataaacatagtatattatatgttgcttacagtttttaggagatagatgaacagacaattacaagacagagtctttagtgataaaagtatgcctagatgagcatactttttgccaaatgggcagagactatgcctagttttcaaagattcattttgtttaatttgcagatttcctacagtaacttaaatataaattttctataattggctttattcagaagggtaaccaaattgccagacttttaaattgcccagtaaataaatgaggacacaacaggaagatattactaggagtttttaatgaggaataattttttatattttatgcactttctaaagtattatgc

SEQ ID NO: 39958 - DNA, 401 bp, Homo sapiens
  misc_feature 6: n = A,T,C or G
catggncgtatatgtaccacattttctttaaccgtctaccattgctgggcattaaggttgattccatgtctttaccagtatgagtagtgctgcagtgaacatgtgcatccatgtgtctttatgatagaatgatttatattcctttgggtgttgtattagtctgttttcatactgctataaagaattctcctagactgggtaattcataaaggcaagagatttaattgacacacagttctgcattgctagggaagcctcaggaaacttacaatcatggcagaatgcaaaggagaagcaggcacgttcttcacagggcagctggatggaagtgagtgcaagcaggggaaatgccagagacgtataaaaccgtcagatctcaggccaggtgcagtggctcatgc

SEQ ID NO: 39959 - DNA, 335 bp, Homo sapiens
  misc_feature 21, 319, 334: n = A,T,C or G
atctcaaatattctgttaacnaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttnaaaaaaaagtttttnc

SEQ ID NO: 39960 - DNA, 334 bp, Homo sapiens
  misc_feature 55, 61, 148, 151, 290, 313: n = A,T,C or G
atagacattctcacataagcccagttcatcaccatttcctcctttacctttcagngcagtntcttttcacattaggctgttggttcaaacttttgggagcacggactgtcagttctctgggaagtggacagcgcatcctgcagggctnctnctcctctgtcttttggagagccagggctcttctcaggggctctagggactgccaggctgtttcagccaggaaggccaaaatcaagagtgagatgtagaaagttgtaaaatagaaaaagtggagttggtgaatcggttgntctttcctcacatttggatgatnggtcataaggtttttagcatg

SEQ ID NO: 39961 - DNA, 102 bp, Homo sapiens
aggatagccgttctgcaaaaatatttataaaacttctcaagatactgctactgtaattttatatgaagataagtgtatttttcaataaagcatttataaatt

SEQ ID NO: 39962 - DNA, 484 bp, Homo sapiens
  misc_feature 17: n = A,T,C or G
tatggccgggctacctncaaaatatatacagtattttgactacttctcacagtgagaagtagatattgttactcccctagtaggagaacttcatcagctctcacttcctttactctaataacatcctggctggtctcccggcatccaccctttgccccctggggtctattctcaacccagtagccagagtgaacctttcaaagtagatgtcagatcgtattactcctgtgctcagaatcttccagcggttccccatttcccgcagaggaggcattaaagcgtgtggttcttcattttatccaaagtaaaaggcagattctttactgaggccttcaaggtactgcatgagttggctgttctttttatttcccaggcctccttttttctactctctccctggccactctgtctccagtcacatttttttcccttgctgttccatgaactcacaaggccacacttccaccatagggctttgcctaga

SEQ ID NO: 39963 - DNA, 378 bp, Homo sapiens
  misc_feature 32: n = A,T,C or G
gtggagcaactggagctgggcctcaagagctnaaacccaccccgaaacagaaagagcaggctattggagcaatccgaaccctgcgcagcaaaagcacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtg

SEQ ID NO: 39964 - DNA, 438 bp, Homo sapiens
  misc_feature 31, 409, 425: n = A,T,C or G
atctgccaaaaatgtcactttgcctgctgtnttcaaggctcctattcgaccagatattgtgaactttgttcacaccaacttgcgcaaaaacaacagacagccctatgctgtcagtgaattagcaggtcatcaggctagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaagggtcatcgtattgaaggaagttcctgaacttcctttggnagttgaagataaagtngaaggctacaaga

SEQ ID NO: 39965 - DNA, 482 bp, Homo sapiens
acctgtgcagagaacaaccctattctgattagaaagatcctgcctgagaaccttttagcttcacagcaggatgtgtacaaccgaagtcgattcaagaaactcatgacgtcatccctcagtcaataatcattgattgaatagagttggtttcagatgtaggtattaggtaccagtagggatacagaaggaaaattcgtggtttccgtctttgaagaataatctggttcagaaaatagttcaaatgtgcatgttttgacatggcttcataacaaaagatcctttcaatcaaaatgctagggaaaccagcattaaaggagagattgtggggcaggcgaggtattggcagcagggacatgggttgtcaggagacaatggaacagaaacaagacatgagaaaaagtgcgagcttaatccataaagctgtttccctccaaaggtgtcagctgcatggcgtgggaggtcaggcaagtgggtctgtgttc

SEQ ID NO: 39966 - DNA, 355 bp, Homo sapiens
  misc_feature 351: n = A,T,C or G
tatggccgggagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaatatatgtgattgttccataataaacttctggngtga

SEQ ID NO: 39967 - DNA, 151 bp, Homo sapiens
cagttatttgtgagggtgtttattctatatgaatattgtttcatgtttgtatgggaaaattgtagcgaaacatttcattgtccccagtctgcaaaagaagcacaattctattgctttgtcttgcttatagtcattaaatcattacttttac

SEQ ID NO: 39968 - DNA, 428 bp, Homo sapiens
gattttattttgcacgtaacaaaaatgaaaaattgaggcacagaattcaagctttgcagaaaaatgtgttggctccctaaccaacacacacacacacgcctactttcccaaattctttcctcctgtatgaaaaaacttaaggctgggcacagtggctcatgcttgtaatccagcactttgggaggctgaggcagcaggattgcttgatccaaagaatccaagaccagcctgggcaacatgatgagaccctgcctctacaaaaagaaaaggaggaaaaaattagctgagcatgccaatagtccctgctactagggaggctgaggtgagaggattgcttgagcccaggaggtcaaggcggcagtgagccgtaatccagccactacactctagcctgaatgacagagcaagactctgtctcaaaaatgagc

SEQ ID NO: 39969 - DNA, 415 bp, Homo sapiens
  misc_feature 32, 361: n = A,T,C or G
gcttttcgatccgcctctgcggtggagccgcnaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggnggatgagaatggcaaaattagtcgccttcgtcgagagtgcccttctgatgaatg

SEQ ID NO: 39970 - DNA, 465 bp, Homo sapiens
  misc_feature 7, 24, 34: n = A,T,C or G
gagagangttgagaacaacccagnaaaccttcanctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagggtgacattattttattataac

SEQ ID NO: 39971 - DNA, 337 bp, Homo sapiens
attctttgacagcctctccctactccaagatttaaaaatgtttacttttgtatttaaagttttgatcaatctggaattttttttgttatgagaggatctatcttcacttttttctaagatggctgcccattcatcttttccctactgagaaacaatatcgtattctaaattctcatatgtctttgtgtcatatttgggcttcctcttctttttcattgatttgcctattcttgtttttattttattttattttattttattttattttattttattttattttattttattttatttttgagacggagcctgggcgacagagtgagaccctgtctca

SEQ ID NO: 39972 - DNA, 196 bp, Homo sapiens
aagactggttaatgataacaatgcctcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 39973 - DNA, 197 bp, Homo sapiens
  misc_feature 33: n = A,T,C or G
caggcatatttttcagaagtattccagaagaangcattgttatcataggagaccacaggggggtctcatagcccctgaagaccttccagtgagataagatgctgaggtggcagatggtggtattgaagattctggccccgtgtagtccctgtgtgtttgtttcttagtgtttaacaaaaatgtataaaaagttttga

SEQ ID NO: 39974 - DNA, 262 bp, Homo sapiens
aagaacgattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagttttt

SEQ ID NO: 39975 - DNA, 484 bp, Homo sapiens
caggaaaaataagaactcaatgaagttgtgacttcattcaaatcacgtagtttatatacatgctattagtaaaacccaggacagctgagtacaagttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattg

SEQ ID NO: 39976 - DNA, 465 bp, Homo sapiens
  misc_feature 15: n = A,T,C or G
ggcccacccctgatnaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtca

SEQ ID NO: 39977 - DNA, 471 bp, Homo sapiens
  misc_feature 33: n = A,T,C or G
ggcagtccggcggtcccgcgggtctgtctcttncttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccactttcttccgcgaactggccgaggagaagcgcgagggctacgagcgtctcctgaagatgcaaaaccagcgtggcggccgcgctctcttccaggacatcaagaagccagctgaagatgaagtg

SEQ ID NO: 39978 - DNA, 490 bp, Homo sapiens
  misc_feature 31: n = A,T,C or G
ggctgcggaaaaattccgttccatccttctnattgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgtcacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactc

SEQ ID NO: 39979 - DNA, 179 bp, Homo sapiens
  misc_feature 16, 35, 44: n = A,T,C or G
aaggccggggggaaanaaggcagcagctaccaagnaaaccagcncctgaaaagaagcctgcagagaagaaacctactacagaggagaagaagcctgctgcataaactcttaaatttgattattccataaaggtcaaatcattttggacagcttcttttgaataaagacctgattataca

SEQ ID NO: 39980 - DNA, 468 bp, Homo sapiens
agtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattacccccactgtcaacccaaca

SEQ ID NO: 39981 - DNA, 466 bp, Homo sapiens
atcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgca

SEQ ID NO: 39982 - DNA, 222 bp, Homo sapiens
  misc_feature 7, 35: n = A,T,C or G
aacccangcaacagaaaactaaacatcacatgttntcacccataagtgggagttgaacaatgagaacatgtggacacagggaggggaccatcacacaccagggcctgttgttgggtgaggggtgaagggagggaacttagaggatgggtcaataggtgcagcaaaccaccatggcacatgtatacctatgtaacaaacctgcacgttctgcacatggatcct

SEQ ID NO: 39983 - DNA, 441 bp, Homo sapiens
  misc_feature 36, 208, 212, 364: n = A,T,C or G
caatatcagaagtaaaaccaaacatacttcttattnacccagtttctctctctctctctctctctcgaaattataaaaacaattaatgcatcctgacccttggaaatgcctcccagccctttaaacaaaatgcaggtttggtgcctgcctgacgattagttttagttaactgaaaattataggattgacccaagaggaaaactttgtntgcnctccaatcacttttacaaattaaggaaaattaccacaattttgtttagctaaggtttcacactgagttcaagaaattagctcagccatcccaacaaagtcagcactttgttagtgagcacttgaaaaaataatagtctttctggagttttgnggtgtatacaaacgaagcgtagagaaagctatgatgctttatagaagtaggccaagtgtttttaattaggctcattg

SEQ ID NO: 39984 - DNA, 139 bp, Homo sapiens
ggcgcactagatatagtaccgcaagggaaagtatgaaaaattataaccaagcataatatagcaaggactaacccctataccttctgcataatgaattaactagaaataactttgcaaggagagccaaagctaagaccct

SEQ ID NO: 39985 - DNA, 107 bp, Homo sapiens
  misc_feature 7: n = A,T,C or G
gtgaaanttaaataatagacatacaggagatatacaaatatattatatatttttctgagatttttgatatctcaatctgcagccattcttcaggtcgtagcatttgg

SEQ ID NO: 39986 - DNA, 186 bp, Homo sapiens
cacccataagtgggagttgaacaatgagaacatgtggacacagggaggggaccatcacacaccagggcctgttgttgggtgaggggtgaagggagggaacttagaggatgggtcaataggtgcagcaaaccaccatggcacatgtatacctatgtaacaaacctgcacgttctgcacatggatcct

SEQ ID NO: 39987 - DNA, 148 bp, Homo sapiens
  misc_feature 7, 8, 34, 142: n = A,T,C or G
caatatnngaagtaaaaccaaacatacttcttanttacccagtttctctctctctctctctctctcgaaattataaaaacaattaatgcatcctgacccttggaaatgcctcccagccctttaaacaaaatgcaggtttggngcctgc

SEQ ID NO: 39988 - DNA, 139 bp, Homo sapiens
  misc_feature 7, 35: n = A,T,C or G
ggcgcanctagatatagtaccgcaagggaaagatnaaaaattataaccaagcataatatagcaaggactaacccctataccttctgcataatgaattaactagaaataactttgcaaggagagccaaagctaagaccct

SEQ ID NO: 39989 - DNA, 107 bp, Homo sapiens
gtgaaacttaaataatagacatacaggagatatacaaatatattatatatttttctgagatttttgatatctcaatctgcagccattcttcaggtcgtagcatttgg

SEQ ID NO: 39990 - DNA, 152 bp, Homo sapiens
  misc_feature 8: n = A,T,C or G
aggaatanggaactcaggcaggtatttgagtaacaatgtgtgtgagcgttgtgtgcgtatacgcatgtgtgcatgtgcacaggagctaatgaaattaaaaatgagccaccgtgcccgaccaagcctgggtaagagaatgagaccctgtctcc

SEQ ID NO: 39991 - DNA, 450 bp, Homo sapiens
  misc_feature 7, 33, 34, 36, 214: n = A,T,C or G
aatgaancaaattttaccataggccaattgatnntncaagatataagttcctactgcatatttctggtcacaatattatcactgtacttctaaatggagactaaaacacttataacattcaacactgaaataagtgtgaggtatacatacatttttaaaaagattaataaaaacaagtaagatgattatttacccaattattccagttcagagnctcgggtggcaagaacctattcttactcagcatgcaatgcaggaataaaccctgcacaggatgctattccatggcagggcacaaccacattcactcacattgggacacacagtggggaaatgccaattaaccagacatgcacatcttggggatgtgagaggaagcaggacttcctggagaaaaccccatgcaggcatggggagaacatgcagacccctacacagatggtagccctg

SEQ ID NO: 39992 - DNA, 217 bp, Homo sapiens
  misc_feature 33: n = A,T,C or G
gaggcactgaggcagccagcgcaggggcttctnctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagt

SEQ ID NO: 39993 - DNA, 358 bp, Homo sapiens
  misc_feature 6: n = A,T,C or G
catttncgatggcttcctgccaaaacaagtcttcagaatgggaggaggtatcatgtgctatctgccagtgtaatttatctttccatgtagctattgaaaactattccaagtgtgcctgcattataacctaatctattgcttatctctaaaaaacaacctttgtgctcatcacaaataaaacatgaaaataatgatagggtcacttttgtggctttctgtgaagattaacttaaataatatatataaaaaatttgaaagagtgcatagccaattgaaagtatggaaagtggcccggcactcatgcctgagattccagcactttgggaggccaaggacaacaaacccagtcctcacctct

SEQ ID NO: 39994 - DNA, 417 bp, Homo sapiens
  misc_feature 270, 301, 382: n = A,T,C or G
ctctgcctgctaatctttgaaatctactgtgcttacatgcctctgccaccccatctatctctgggaaaagctcaatatcccgatagattatcctaaggtgggcttgcagggcagcactcagtcaacaactctccagcctgggtgacagagtgagaccctgtttctaaaaaaaaaattacatttctattattactaatgataatgcgtgtctcttcatatgctttttacccactttgctaccctttttaatgaaatgccgattactatggntggaatatttgtccccactaaaactcatggngcaaccttgatatggtttggctgtgtccccccaacccaaatctcatcttgaattgtaatccccataatccccacatgttgngggaaggacccagcaggaggtaactgagttatggg

SEQ ID NO: 39995 - DNA, 211 bp, Homo sapiens
ggggcacggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttt

SEQ ID NO: 39996 - DNA, 441 bp, Homo sapiens
  misc_feature 8, 34: n = A,T,C or G
ggtaggancctctctccctactgctgctacacangtaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctg

SEQ ID NO: 39997 - DNA, 436 bp, Homo sapiens
  misc_feature 7, 33: n = A,T,C or G
gaggcantgaggcagccagcgcaggggcttctnctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttg

SEQ ID NO: 39998 - DNA, 385 bp, Homo sapiens
  misc_feature 213: n = A,T,C or G
gtgtgcgaaaagctttcgtaagataaattgctatgcacatataagttgttatctgattatcatttttctgaatgaaggaccagtaaagatatggtagaacagatgaaatctgaactgggtcccaaagaatgggtagtactttcacaggtgcagaatcttgaaatggaattttaggcagagggaataatagcatgaggaaaaaagaatcatggntataaagtttaggggactgtctgggagaaatcaacagtttatttaaccacgggccatatttatgtggcaaagtagtgcaggagaagcaaaacaaagcagattatgccatattttgaaggaacctgaagtcaaagccaaaaggagcaagaagtggaggaggaggaagaggaga

SEQ ID NO: 39999 - DNA, 475 bp, Homo sapiens
  misc_feature 34: n = A,T,C or G
caccacctttcctggccttgctatgggatgcttnccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgaga

SEQ ID NO: 40000 - DNA, 213 bp, Homo sapiens
gtaaaaacctggacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctattt

SEQ ID NO: 40001 - DNA, 378 bp, Homo sapiens
tatggccgggattctacaagttgtctcttcactctgttgttttctttgttgtgaagggcttttttagtttactataatctcatttgcctatttctgcttttgttgcatgtgcttatgaagccttaaccataaaatctttacctaaatcaatctcctgaagcatttcacctatgtctttaattttaattgatttttgtataggtaagaaataagagtctagtatcattcttctgcatatgaatgtccagttttcctagcactgtttatttaagagggtgtcctttccccaatgtatgttcttggtgcctctattgaaaatcagttgtatgtttctgggttctatgtatgtttttgggttctctagtatgtatgtttctg

SEQ ID NO: 40002 - DNA, 369 bp, Homo sapiens
  misc_feature 7, 32, 212: n = A,T,C or G
catttanttgctgttattgatagtggtgaacntttatgaaaaagaagtaaaaaaccccttgccggccagatgcggtggctcatgcctgtaatcccagcactttgggaggccgaggcaggcggatcacttgagattgggagtttgagaccagcctgacgaacatggacaaaccccgtctctactaaaaatacaaaaaattagctgggcgtggngttgcatgcctataatcccagctactcaggaggttgaggcaggagaatcgcgtgaacctgggaggtggaggttgtggtgagccgagatcacaccattgcactccagcctgggcaacaagagtgaaactcagtctccaagaaaaaagaaacaacaaca

SEQ ID NO: 40003 - DNA, 490 bp, Homo sapiens
  misc_feature 7, 31, 33: n = A,T,C or G
gtcaccntgcgtcagaagactgtggactggntnagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccccgggagcctcacgtattttagaagccaagagaagccacatggagactcaaattcgcatcttctctatccacatcatgaccaaaggaacccctccctggtgtctgatcagggctgtggcatcacgaaacattggatcatgaca

SEQ ID NO: 40004 - DNA, 368 bp, Homo sapiens
attctcttgactgtattttacctcatttcttgcaatcttggtttttgtttttaaatccttgtcatgccctggaaatgatctgtttcaggaagaatagatttctgttttataagtagaaaattctgagttttgaaaataattacttaattgctaataataaagaaatgtagcctggacaacacagcaagaccatgtctcttcaaaaaataaaaaataaattagcagggtgtggtcttgcacacctgtagtcctagctattcgggagggtgaggtgggaggataacttgagctgaggagtttgaggctgcagtgagctatgattacgccactgcactctggcctccagagtgagaccctgactcttaaaa

SEQ ID NO: 40005 - DNA, 472 bp, Homo sapiens
  misc_feature 30: n = A,T,C or G
aactccagaaatgatcgctcgttctgctgnttccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtacatgctacaaaaagaggggaatatgagccgagga

SEQ ID NO: 40006 - DNA, 102 bp, Homo sapiens
agggtgatcacagctcaccgccaccttgacctcccggactcaagtgatcctcccgtctcagcctccacagtagctaactggaactacaggcatgagccaccg

SEQ ID NO: 40007 - DNA, 375 bp, Homo sapiens
gtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtaga

SEQ ID NO: 40008 - DNA, 472 bp, Homo sapiens
  misc_feature 6, 34: n = A,T,C or G
aatctncaattggggcagtactcatggcttctcntttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcaggagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaac

SEQ ID NO: 40009 - DNA, 177 bp, Homo sapiens
  misc_feature 3, 86, 135, 154, 161, 176: n = A,T,C or G
atnactgcccaacatcagaaaacctgacggctatgattactatgccttttctaaagatcaatactataacattgatgtgcctagtngaacagcaagagcaattactactcgttctgggcagaccttatccaaagnctggtgcaactgtccttanactgatnagcaaaggaggaggna

SEQ ID NO: 40010 - DNA, 379 bp, Homo sapiens
  misc_feature 6, 32, 94: n = A,T,C or G
aagggnaaatctgcacagttgctcccaccaantctgaatggatttgaggttcagctgcaatgcagtggtgtgccattgggagaaagaatacttnagtgagaaattccgcaggttctcctcctggtaggtgtgtgtcctcagtgagccagagacaagagacccaaatttgccattcccagagttggccccagttcccttgtttctcttatggtgtgagcaccttgaggcaccaagcatgtgtctggtgtttgatgatatttatttctcatacgatatggccctcatagcaagccaattaatttattggccactcaaatactcaatagtctgactcagcaatggaaggcagatggttgtgttggactcattggaagataac

SEQ ID NO: 40011 - DNA, 485 bp, Homo sapiens
  misc_feature 7: n = A,T,C or G
atccccnagattcatcacaattcactccctgagaatagacagaaggagaagccctacaagatcacactggagttttccccaagttgagtaagtctctgatggtttcctccttgaaggcaggaactgggctgtgcaattttttgagactcttaccagctctcaatccatgcctccatatagtgaatccctcatgttttagctcattagcatctccaaactctttatagcattgcatttggatctctccagtgaaagtatttctttatatgaccaaagataaaggactttggcttcactttttggaatagttcattgatcattaggtaccaatttttagtgcttcattaaaagtgaaagtaatttattgtaatgggattatgtggttcccaacactgagagaacattgaacccagaatgtgacactaatcataaaaataaaatgctcactctcatcttcttgaccagtgggaaattgtctaatattt

SEQ ID NO: 40012 - DNA, 457 bp, Homo sapiens
agactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatac

SEQ ID NO: 40013 - DNA, 177 bp, Homo sapiens
catctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaagaataaatttttatat

SEQ ID NO: 40014 - DNA, 487 bp, Homo sapiens
  misc_feature 4, 27: n = A,T,C or G
accncaggtgactccatggcctaccantttggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagt

SEQ ID NO: 40015 - DNA, 412 bp, Homo sapiens
aggcacacgaataaagataggattgggaaagaagttgctaagtgtgcttagttttaataagtaattccttctctttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaac

SEQ ID NO: 40016 - DNA, 228 bp, Homo sapiens
atacttctgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtgg

SEQ ID NO: 40017 - DNA, 452 bp, Homo sapiens
caagaactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggaagtcggacgaggatat

SEQ ID NO: 40018 - DNA, 482 bp, Homo sapiens
  misc_feature 7: n = A,T,C or G
aactttnaactgatttaatatttctatttacatttatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatg

SEQ ID NO: 40019 - DNA, 289 bp, Homo sapiens
  misc_feature 17, 34, 286, 289: n = A,T,C or G
gatctccacctattctnaactttaaatgggtaanaagcccggctcgctggcgtggagccgggcgtggaatgcgagtgcctagtgggccacttttggtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatncan

SEQ ID NO: 40020 - DNA, 453 bp, Homo sapiens
  misc_feature 33, 34: n = A,T,C or G
gcagacgaggttagacaccttaagaccaagtcnntcggatgaggagatgctgttcatctatggccactacaaacaagcaactgtgggcgacataaatacaggacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttg

SEQ ID NO: 40021 - DNA, 343 bp, Homo sapiens
gctttccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 40022 - DNA, 471 bp, Homo sapiens
  misc_feature 377, 422, 430: n = A,T,C or G
agttggcttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtggtcccggcactgtgggaggctgaggcgggaggatcatctgaggccaagagttcgagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatcngatgatgaacttaatgtttccatttgtattaatggaatactaagnccctctgngatttctgaaccaagctattcctaggcctgagttttatttt

SEQ ID NO: 40023 - DNA, 250 bp, Homo sapiens
  misc_feature 33: n = A,T,C or G
gatctctactattgaggaaaaattggaggcatnaaactccaagggcaaaacatgaagactcgctggcccaccatggatggaggttttctctcttaaaattcccacagcaccgcatggaactgcctctcctgggacctcagcgtttccttctttgctctaagcaatagcctctgccactggagattctgagatggccgatttccttttggatatttaagttttgaaatcatgctcatttggcataggaatg

SEQ ID NO: 40024 - DNA, 302 bp, Homo sapiens
  misc_feature 8: n = A,T,C or G
caaagaanagagtaaagctatgtcttcaatttaatttcatacctgatttgtactttccttgaaagctttactttaaaataccttacttataggcctggtgtcatgctataagtatgtacatacagtttcacttcaaaaataaaaaaaaaatccctaaaaactctctatactctctataacaatactttattcaagaactctggacaatggtattatttttaaaaatcatggggatgtatttattagaatgtttcttataaatctgtttactttttatattaagaattaaactgtccctaaga

SEQ ID NO: 40025 - DNA, 471 bp, Homo sapiens
  misc_feature 5, 30, 31: n = A,T,C or G
aggancgaaaaacctacctgttttctatgnntcgtgacatatattctctggtagtccttgtgatcagacatacacataccacatattgattacaaatagggtattaaacaaagtaagtaactctagaccctaccaccacttcagtgacccgaaatccactatttaccaacaatagctagtaatagcaatttttggtcacataattaagcagcattttctttccctgattatttaagaaaaactaagtaaatttatctcactgaagaatattttaagccttaagtcaacattaaatttcttgttattgattataaaccagtatacttcaagaggatatatttctgtatataaaagtagtctttcataactgtctgtatttctaagttaatatataagtttatctagataaaaaatacttaagaaacataaaccaaaatattttatgaaattgtttttatattagctaagtat

SEQ ID NO: 40026 - DNA, 417 bp, Homo sapiens
  misc_feature 14, 32, 52, 58, 81, 99, 213, 363, 364: n = A,T,C or G
agatccttgcttanaactgattggaatctttntcgcctactgcctctctcgngccatnacaaataaccagtatgagatagngtaacccaatgtatctgngggcctattcctctctacctttaaggacatttagggtcccccctgtgaattaagaaagttgcttggctggagaactgacaacactacttactgatagaccaaaaaactacaccngtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgnngaaaccctgtatccctctgaaacactggaagagctagtaaattgtaaatgaag

SEQ ID NO: 40027 - DNA, 297 bp, Homo sapiens
  misc_feature 1, 5, 11, 17, 26, 34, 38, 109: n = A,T,C or G
nttgntcaagnggctgncaactcagnaccctggntggnatttacagacccttaatttaagtaaaacagaatgcctccatttagttctagaaggaccttctcctttagangaaccaagtgttcaaattcccttcttctctatgaactcagcattcattttatccataatgatcaatttaaaagtagagaaacttgtcagttgagagatctgattcccaagagattggtttcacttgtctacctgaattttgtgattggattttgttgttcgttttttaagattgaattttgttaccac

SEQ ID NO: 40028 - DNA, 423 bp, Homo sapiens
caaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataag

SEQ ID NO: 40029 - DNA, 463 bp, Homo sapiens
  misc_feature 33: n = A,T,C or G
gagctcccgggtggacctgcgggaccatggggntacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatc

SEQ ID NO: 40030 - DNA, 127 bp, Homo sapiens; identical to SEQ ID NO: 32606

SEQ ID NO: 40031 - DNA, 145 bp, Homo sapiens
aggcacgctggcacctgcctgtaatccaagctacttgggaagctgaggtaggagaattgcttgaaccgagcaggcagaggttgcagtgagcccagattgtgccattggacaccagcctgggcaaagaagcgagactccgactcac

SEQ ID NO: 40032 - DNA, 421 bp, Homo sapiens
  misc_feature 8, 34: n = A,T,C or G
ggctgttngtgatcttcatagtgggtgaggatcntctcagaggtaacattgaatcctttctttgtaaaggaaaaccttaattgaaagttactgtgccagcaatatataaagtgaagtctaggacccccagataaaattctcagaaagtatactcatgttctttctagagatagaaagctatataaattcagaggtaaaacttaattgaaacaagagctgactataaatatgttgttttatgaaaaattaagtagtgattcttacagccatggctttgtcctctctcattgagaattagtgtcataatgagcctcttttatttgtaggcacctatggtgtccctcaggtctgttaacaggagaaagggtaaataagtttatttagaaaacacctaaactaagtgtagttcatgttaattttc

SEQ ID NO: 40033 - DNA, 464 bp, Homo sapiens
  misc_feature 8, 20, 22: n = A,T,C or G
gagtgccngatgaccccagnancgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaagagaccagagagatatgcgggcaattcagcctgatgcaggttat

SEQ ID NO: 40034 - DNA, 215 bp, Homo sapiens
caaattcctaatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaaacatttataaagt

SEQ ID NO: 40035 - DNA, 395 bp, Homo sapiens
  misc_feature 1, 17, 34, 37, 54, 58, 63, 69, 70, 95, 101, 156, 169, 205,213, 288: n = A,T,C or G
naatctatattataaantagagataaatctattngangctctatgtaaggaganttanagccnaactgnntaagctgtatcatcccaacaaagtntccttncatgaacggggcatgcgatatgcttaagaattgctaggattaaattaaggaaagnaaagctactcagnagcagcaggttccacaagcacaaactttacacattngtacaatngggaaatgcactacaataaacaaattatgagcaacacatttgaaatacaggcttctttacataaactgagaggtnatacaaaactcagtttcacaagggaacaatctatacctttctaaaagttaatatttcaagtctctaataggcagaatattttactctttaaaatcctgcctttctga

SEQ ID NO: 40036 - DNA, 456 bp, Homo sapiens
ccgccggaaccgccatcttccagtaatttcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactttaagagccgagatagcttcctgaaacgtgtgaaggaaaatggatcagaaaaagaaagaagccaaagagaaaggtacctgggttcaactaaagcgccagcctgctccacccagagaagcacactt

SEQ ID NO: 40037 - DNA, 467 bp, Homo sapiens
gtataaccaggaaaatattgtatataatctcaagtcagattgttttcttttgaaaagtattcatatatgttaaagatgtagttctagttcattcattttctctgttttgactcttttatacatatactacagctcatttatccattttcctactgttgcaacatagattgcttataattcttctaattactaacaatgctggtatgaaattgttgtgtatatctctggtagatatgtgttatttcttttttgcaatgctagattataattatttgtctaaggtggagattaccagggtagactcgctctggccgtatgtaatgatgtctgtggctacataacctgccaacacttagtcttatcacacattttattttaaaatcaatatgtaaaaaatactaatttacttggtagtaatttaaatttttctgattattactgagggtgaatatgttttcatatgttta

SEQ ID NO: 40038 - DNA, 485 bp, Homo sapiens
  misc_feature 5, 32: n = A,T,C or G
aactncgcatccgcaaactctgtctcaacatntgtgttggggagagtggagacagactgacgcgagcagccaaggtgttggagcagctcacagggcagacccctgtgttttccaaagccagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctgggcttctatgtggtgctgggtaggccaggtttcagcatcgcagacaagaagcgcaggacaggctgcattggggccaaacacagaatcagcaaagaggaggccatgcgctggttccagcagaagtatgatgggatcatcctt

SEQ ID NO: 40039 - DNA, 210 bp, Homo sapiens
aaaagtcttaatgatgtaaaccctgactgctaacttaaaataaaaaatagtgattcaactatattgagaggatggggtgggggacatagtaagagctacacaatctcgtaactctatcataacaaaaaatttgtctaaatatgcctataaatgtctaaaatgacatatcaagaaaaaagaataagcataatactatagagataactaccg

SEQ ID NO: 40040 - DNA, 182 bp, Homo sapiens
  misc_feature 6, 33: n = A,T,C or G
gaaagnttaattgggagtggtaggatgaaactntttggagaagatagaagtttgaagtggaaaactggaagacagaagtacgggaaggcgaagaaaagaatagagaagatagggaaattagaagataaaaacatacttttagaagaaaaaagataaatttaaacctgaaacgtaggaagcga

SEQ ID NO: 40041 - DNA, 297 bp, Homo sapiens
  misc_feature 5, 31: n = A,T,C or G
gtggncattggcccagtctgtttcaaataantgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcatgagcattgtgcaatacagtttcattaactccttcccccgctcccccaaaaatttgaatttttttttcaacactcttacacctgttatggaaaatgtcaacctttgtaag

SEQ ID NO: 40042 - DNA, 414 bp, Homo sapiens
  misc_feature 27, 33, 35: n = A,T,C or G
gaaagaccagtggggtaaaaccccagnacgccntnaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatg

SEQ ID NO: 40043 - DNA, 462 bp, Homo sapiens
  misc_feature 31: n = A,T,C or G
taacataaattatacagccatagagtagttnttaaaggtttgctaaaaacgtgtaaaccatgcaactataacagtgaatttcagcctacattctcaattatgttggacccaatatttctaatagtgggaaagctattttcctaagaattaatccatatattgtctaaaggcaatattgccactttaggggcaacaattgcttcttgggagacaacaaaagcttactctttttatgtagacagcaaagacacatatacatatacagtatatctagtgcattaacatttcatatttggacaattaggaaaaactatttaaaatggttcactggggaagatgctagtgaaaaaactggagaaatactgatttaggctattatctacccttgatttattgatggttcaggagagaaagagggcagtaccgttctttttgcattgctttcttttcttgtttctcttc

SEQ ID NO: 40044 - DNA, 336 bp, Homo sapiens
  misc_feature 30: n = A,T,C or G
gattgcgaggagctgagggcagggtgaggnttgtttgactctggaagtatcaggcctgtgcagtaaactcagctctgctccgtatggagtcctgcggcctccacaaagagtcaccgctagctctcttgagctccagagcatattttgctaggccctgctccatacttcctaaaacaccactgcacagttgtcagtcataagagttcaactgccaaaaagattgaattatgctagaatgagaacacagcagtgttttgcatctcctcttatttctcgtgattgtgaaactaaagtgaaagagatcatttcaaccctaattctgcacatcagatattt

SEQ ID NO: 40045 - DNA, 316 bp, Homo sapiens
  misc_feature 34, 36: n = A,T,C or G
cacattgccccaagttatcatgtccatccgcacntngtctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagcacatccccaatcgtggccctctggacaagtggcgggccctgcactcatgagggcttccaatgtgctgcccccctcttaatactcaccaataaattctacttcctgt

SEQ ID NO: 40046 - DNA, 298 bp, Homo sapiens
  misc_feature 4: n = A,T,C or G
aagnatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaact

SEQ ID NO: 40047 - DNA, 251 bp, Homo sapiens
  misc_feature 34, 35: n = A,T,C or G
cttatcccagtaagatgggtgaccacctgacctnnctccacaggctgggtggcccggaggctgggctgggcgagtatctcttcgaaaggctcactctcgagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgat

SEQ ID NO: 40048 - DNA, 455 bp, Homo sapiens
  misc_feature 32: n = A,T,C or G
tgcttaccgttaagtttttaacgtaattttanttgcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggag

SEQ ID NO: 40049 - DNA, 230 bp, Homo sapiens
caggtgccccagatgtggtgtgagaggcaggctcacctctgtgggattctctcctaaaaccagtaacctttctttaatcatgagaaatacaccagatgacctgaggctggggatgttctacaggagacctgtccagcactccttaagctgagagggttattaatgcaaggtgggaccctggcttggatcctggggccgaaagaggatgtcagtggaaaaacagcaaaatc

SEQ ID NO: 40050 - DNA, 303 bp, Homo sapiens
  misc_feature 11, 35: n = A,T,C or G
gataacacagnagggaaagggaaagccacctggtncttgtccaccctgcctcccctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaccttg

SEQ ID NO: 40051 - DNA, 498 bp, Homo sapiens
  misc_feature 470: n = A,T,C or G
gagtcatgggggtggttaccctcatgctgttttcatgagagtgagttctcacaagatctgatggttttatatgggggcttttccccacttcactcttgttcttctctgtcctgccactatgtgaagaaggacctgtttgcttctgcttcagccatgattgtaagtttcctgaggcctcctcagccatgctaaactgtgagtcaatgaaacttcttttctttataaattacccggtctctggtatgtctttattagcagtgtgagaacagactaatacagtttgcaaagggggtcttgttatgtagatgaaacctcacaggtagcaaccctcagagacaatagatagtaaatgtttccttgagacctttaaaggtgtcagactctcagttagtctttcttggatccagacaagggagaaggcctggcagtataaatgcaggttccctacagatgatgtaaatttctcccangaaagacagctttgcagagctactttta

SEQ ID NO: 40052 - DNA, 487 bp, Homo sapiens
  misc_feature 7, 33: n = A,T,C or G
gaggcancgaggcagccagcgcaggggcttctnttgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggtgattaaaagaccttg

SEQ ID NO: 40053 - DNA, 346 bp, Homo sapiens
  misc_feature 30: n = A,T,C or G
agccccggggagagttctcttttctttgtnaagggcagggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattg

SEQ ID NO: 40054 - DNA, 444 bp, Homo sapiens
  misc_feature 31: n = A,T,C or G
tttgcactgcaatatattgagactaattttnaagctataataatgaacatacagtggcagtggcacaaataccaaatgccaaacgtgccaatggaataatagctcagaaacaggaccatgcatatttagatacttaatatatgatagagtggcagaacaaactccttaagcagtggtatagggacaattgggtatccatgtagaaaactcatgaaattggacttacctcagattttatacaaaattacctccaggatgcttatagacctaaatgtaaaaggcaaaattataaagctatttgcaggataatataggagaatatcttcataattttggaaaggatttcttatataaggcataaaaatcactatcatatggataactggaaaggaaaaaactgataaatttgactccgtttaagaactctgcatccaaagataagcg

SEQ ID NO: 40055 - DNA, 277 bp, Homo sapiens
  misc_feature 2, 4, 147, 155, 159, 217, 246, 259: n = A,T,C or G
gncncggagagaccccttcagagcagggattgtgccgggagagtgcctctgactttgggacatttcatccacagaaatttccaagccaatggtttcttttgggttttggtttttatgtttgttttttggggtttggaaaaacatgcntttttacngggngcgtgaattggtcagcagaaaagggagcccagaaaaggcagcagatggaccatacccncgctgggttttccttttctttgggactgngaggggaaatggnttttagaggtgagggttg

SEQ ID NO: 40056 - DNA, 494 bp, Homo sapiens
  misc_feature 23: n = A,T,C or G
cagtacgaatacagaccgtgaangcggggcctcacgatccttctgaccttttgggttttaagcaggaggtgtcagaaaagttaccacaggggggcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtg

SEQ ID NO: 40057 - DNA, 464 bp, Homo sapiens
gtgaaccctgtgatggagacaaagcagtggggtttggaaaccaaggaaggccccaccgacatcttacttctcggccatatgcctgcgagctcagcgccaagcagttccagagcccttccacactcaaaatgcacatgagatgtcacaccggggagaagccataccagtgcaagacctgcggacggtgcttttcggtgcaaggaaacttacagaaacatgaacgcatccacctgggcttgaaggagttcgtctgtcagtattgcaacaaggcattcaccttgaatgagaccctcaaaatccatgaaagaatccatactggagaaaagcgttaccactgtcagttctgctttcagagatttttgtatctctccaccaaaaggaatcacgagcagaggcatattcgggagcataatggggaagggctatgcctgcttccagtgccccaaaatttgcaaaacagctgc

SEQ ID NO: 40058 - DNA, 500 bp, Homo sapiens
taaaactacaggttctaccccagacagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagc

SEQ ID NO: 40059 - DNA, 187 bp, Homo sapiens
cttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtg

SEQ ID NO: 40060 - DNA, 184 bp, Homo sapiens
  misc_feature 7: n = A,T,C or G
atctganaacagaaataacaccttcaaaattgttgtgacaattaactgatgttaaaaatacaaatgggccaggcacagtggctcatgcctgtaaccccagcactttgggaggcagaggcgggtggatcacttgaggccaggagttcaagaccagcctggccaacacagtgaaacaccatatcta

SEQ ID NO: 40061 - DNA, 466 bp, Homo sapiens
  misc_feature 7, 60: n = A,T,C or G
caagtcncacatggtgagcgtggactttccggttatgatggcagagatcatctctgtgcnagtgcccaagaccctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatgggggttgtatgcctttaaatctgtgatgatcctcatatggcccagtgtcaagttgtgcttgtttacagcactactctgtgcca

SEQ ID NO: 40062 - DNA, 483 bp, Homo sapiens
  misc_feature 33: n = A,T,C or G
acccccaaacggattatccggaagccaaggttngctcggtatcttaaatagtgaagatggagaaatagtcaataatgaagagcatgaatatgcatccaaaaaaaggaaaaaggaccattttagaaatgacacaaatactcaaaaggcatggctattgcaccttgggagaagcctttaatcggttagacttctcaagtgcaattcaagatatccgaaggttcaattatgtggtcaaaatgatgattattccccaccttctaagagacaaagaccaacgagccaccacagccaccaatcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctg

SEQ ID NO: 40063 - DNA, 296 bp, Homo sapiens
aaagaaagccccagcgctctagagctcagctgacgggaaagggggtgcgcagcctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaact

SEQ ID NO: 40064 - DNA, 221 bp, Homo sapiens
atgttatggctatgacagacatatctaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtat

SEQ ID NO: 40065 - DNA, 171 bp, Homo sapiens
  misc_feature 34, 35, 59: n = A,T,C or G
gcacctccttctttgcatttaataataaatatannaatttctggctgggtgtggtagtncatacctgagtagctgggagattgagatgggaggatagtctgagcccaggagttcgaggttacagtgagctatgattgtaccattgcactccccctgaagaccccatctcta

SEQ ID NO: 40066 - DNA, 238 bp, Homo sapiens
  misc_feature 32, 33: n = A,T,C or G
gattacatgtgtctgtctggcctgatctgtgnntctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagact

SEQ ID NO: 40067 - DNA, 116 bp, Homo sapiens
  misc_feature 7, 9, 34, 35: n = A,T,C or G
aatgttncnccacccataatcctttctgccgacnnctagttccctctgctcagccaagcttgttatcagctttcagggccatggttcacattagaataaaaggtagtaattagaac

SEQ ID NO: 40068 - DNA, 487 bp, Homo sapiens
  misc_feature 29: n = A,T,C or G
ctctcttcctgtctttgtggctccggaanttcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcatt

SEQ ID NO: 40069 - DNA, 465 bp, Homo sapiens
  misc_feature 8, 31, 58: n = A,T,C or G
agtttacntttcttaggtttattcccacatntttggtgagatttgcccatgatttcanactttacctggggaaataaaccctattcctggttcacaatgtgatggattttgagaatttataaatcaggaaagacttataaatgcattccattttatttcatgggcatgtagcacaggataaagtggcaagaatcttcaactgctacatattttccatgattgtgagagctaaagcagaaggaaagtttaatgtttctcaaagagcaaagacaaacagaaagcagaaggcctgaggatcagcatcacataaacaacaagctgaggagcaggggatccccgagagagtcaagaaactgagggaggaaaggtttatgggaagggaagaagtgatgaatggtgtgaaatgtcacctagtggtcaagcaagaggatctgaaacattttcctttgtgtttatgaatttgag

SEQ ID NO: 40070 - DNA, 381 bp, Homo sapiens
ctgagcccggttctggggcgaaacgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttat

SEQ ID NO: 40071 - DNA, 127 bp, Homo sapiens
  misc_feature 25: n = A,T,C or G
aaagaaacccactaaattttgcttngtttccttgaagaatgtggcaacactgttttgtgattttatttgtgcaggtcatgcacacagttttgataaagggcagtaacaagtattggggcctattttt

SEQ ID NO: 40072 - DNA, 367 bp, Homo sapiens
  misc_feature 25: n = A,T,C or G
cattatcttaagtacattgtacatntctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaaga

SEQ ID NO: 40073 - DNA, 385 bp, Homo sapiens
  misc_feature 32: n = A,T,C or G
aagtgacagccttgtgtgtgatcttttctgtnttccccaagtttgcattttcgacattaaagtttactttttagttaaaagttttaaaaatatatatatataaatacactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatattagttttcactcagtcattttatgaataatatagttatccacttaaacatttcaatattttaaccatcttgaaaattaaagattaaaaatcccca

SEQ ID NO: 40074 - DNA, 443 bp, Homo sapiens
  misc_feature 32: n = A,T,C or G
cggtcccgtactgggagatacagccatccacnttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcat

SEQ ID NO: 40075 - DNA, 490 bp, Homo sapiens
  misc_feature 32, 34, 59, 212: n = A,T,C or G
gaaagaccctgactggtaagaccatcactctntntgtggagccgagtgacaccattganaatgtcaaggcaaagatccaagacaaggaaggcatccctcctgaccagcggaggttgatctttgctgggaaacagctggaagatggacgcaccctgtctgactacaacatccagaaagagtccaccctgcacctggtgctccgtctcagaggngggatgcagatcttcgtgaagaccctgactggtaagaccatcaccctcgaggtggagcccagtgacaccatcgagaatgtcaaggcaaagatccaagataaggagggcatccctcctgatcagcagaggttgatctttgctgggaaacagctggaagatggacgcaccctgtctgactacaacatccagaaagagtccacttctgcacttggtcctgcgcttgaggggggggtgtctaagtttccccttttaaggtttcaacaaatttcattgcactt

SEQ ID NO: 40076 - DNA, 457 bp, Homo sapiens
ggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcacacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 40077 - DNA, 193 bp, Homo sapiens
gtgaggctgccttccggaaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagt

SEQ ID NO: 40078 - DNA, 364 bp, Homo sapiens
gaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaac

SEQ ID NO: 40079 - DNA, 454 bp, Homo sapiens
tcaagacgattcttcccctcggcctcccaagtagttggtattataggcacagaccatcatgcccagcaaggtcactttcttgacacactgtctctcacatctttttctcttctttcatttttcaagacaatagctgtctgttcagagaaacagtatggtgggcagggcctcagtagggcaggggtgtgttcacagataagccacccattaactgcaacagaagctgggcctcagctgggcatggtggctcacgcctgtaatcctagcactttgggaggccaaggtgggcggatcacctgaggtcacctgaggtcaggagttcgagaccagcctggccaaggtggcaaaaccctgtcgctactaaaaatacaaaaattagctgggcatggtggcacacgcttgtaatcccagctactcaggaggctgaggcagggagaactgcttaaacctggga

SEQ ID NO: 40080 - DNA, 390 bp, Homo sapiens
caaggacggcaagctgataagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgac

SEQ ID NO: 40081 - DNA, 469 bp, Homo sapiens
gggaagtctgcgtggtttctcttcctgtttgcagctgtctttttgtgaatttgtaaataaatacagaaatttaagttaatattttgtatcaattttgccatgaaatcaaaatattaagtgaatattattccaacattggtaagttatatttttattattttgttaatgtttcattaatggatgtattaaaatgctttagtataaaatactttgctcttacttagaaaaaggactttgaggctgggcactgtggctcacgcctgtaatcctagcactttgggaggctgaggtgggcggatcacttgaggtcaggagtttgagaccagcctgaccactgaggtcaggagtttgggaccggcctggccaacatggtgaaaccctgtctctactaaaaatgcaaaaactagctgggtgtggtggcatgtgcctgtagttctagctacagggaaggctgaggcacaagaatcgc

SEQ ID NO: 40082 - DNA, 159 bp, Homo sapiens
cgactcttagcggtggatactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcg

SEQ ID NO: 40083 - DNA, 142 bp, Homo sapiens; identical to SEQ ID NO: 23637

SEQ ID NO: 40084 - DNA, 247 bp, Homo sapiens
  misc_feature 179, 200, 213, 226: n = A,T,C or G
gagtagcatcaaaggctgttctcaaaaatgaaagacgaatgagcagacacagtgtgtcacatcagcaacttttttcccagtttctttgtaaatggaagtttatgaaaaggagaactaactcaaatcacagaatcctgtgtttgaaataaatggtcttgcaacaaacatttgcgtctgcnaatgtctaaacctttcaaaanattaaaggaaatnaatgctggcgtgncgcattaattgggcaccaccg

SEQ ID NO: 40085 - DNA, 440 bp, Homo sapiens
atagtactgtactatacgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgctatctgtgtaaaatggacttctgaccgcaagtatattatgtgtggatctgatgaaatgaacattcgcctgtggaaagctaatgcttctgaaaaattgggtgtgcttacatcacgaga

SEQ ID NO: 40086 - DNA, 313 bp, Homo sapiens
gatataaaatttaagtatttttctcttaaatattccctatgaaaaaggcaacaggacaaacatgatgatcaagatcctggaaatttggctacagtgtgagaaggaagacagttgtttacagtagcaactgtaacgtctggagggagtttatacccaatctaaagagtccagaatgttgccatatggcaacgtggacccaacattgttacaacttctaccttcaagccagctggaagtctgtttttgcttttttggttttttaatgtgaaattttttgatttgtaaatttggtagccaattgaaataaagaagg

SEQ ID NO: 40087 - DNA, 469 bp, Homo sapiens
  misc_feature 54: n = A,T,C or G
gaggaggatgtgaaactcttaagtatatctggaaagcggtctgcccctggaggnggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagccaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaag

SEQ ID NO: 40088 - DNA, 400 bp, Homo sapiens
cattgagtggtgttgagagtgaagtttcactagcagggaagtttccttgagcctaaaataaaaagaaaaaattaaaaagaatcagtttttttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataagga

SEQ ID NO: 40089 - DNA, 257 bp, Homo sapiens
  misc_feature 19: n = A,T,C or G
agggatattttccccaagnaaatacatatatttcttttcttttttttatcatccagatcaaaatgtcaataaataaatttcaggatttcagaaatgtcaccatttacattcaaagtgggggaatatattgaaaaagtagatgcttactagtaggttagattctatttagtgaaccaaccgccttgtatatttggttgtaatttctgtctaagccaaaaccaaattattataagtcaagtcctttcatagttgctgac

SEQ ID NO: 40090 - DNA, 355 bp, Homo sapiens
ctcattcccttgactcatgtcttgccggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttc

SEQ ID NO: 40091 - DNA, 248 bp, Homo sapiens
  misc_feature 218, 230: n = A,T,C or G
tgagcaagggatctagaagaatagaaatgtttggatttaagatttcgaagagaccagcctggccagtatggtgacaccccgtctctactaagaatgcaaaaattggcctggcgtggtggcgtgcgcctgtggtcccggcaactcgggaggctgaggcggaagaattgcttgggcccgggaggcggaggttgcagtgagctgagatcacacccactgcntcccagcctggngacagaccagactttgtt

SEQ ID NO: 40092 - DNA, 371 bp, Homo sapiens
gaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttga

SEQ ID NO: 40093 - DNA, 125 bp, Homo sapiens
caaaaggacacttctgattaagacggttgaaactagagatggacaggttatcaacgaaacttctcagcatcacgatgaccttgaataaaaattgcacacactcagtgcagcaatatattaccaac

SEQ ID NO: 40094 - DNA, 306 bp, Homo sapiens
gggcgtgagccactgtgccggtatagaatgcccttcatagcaacatttcccccaatccaggaaccaacccaggatcacttgttgcctgttgttttttagacagagtcttgttctgtcgcccaggctggagtgcagtggcatgatgtcggctcacctcaacctctgcctcccgagttcaagtgattttcatgcctcagctactcaggaggctgaggcaggggaatcacttgaacccgggaggcggaggttgcagtgagctgagatcgcgccactgcactccagcctggtgacagagtgagactgcat

SEQ ID NO: 40095 - DNA, 467 bp, Homo sapiens
ggagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaaagaagttgatgaaatgatcagggaagcagatattgat

SEQ ID NO: 40096 - DNA, 306 bp, Homo sapiens
ggagccgacatcgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtggagatgtgtgggcacatgttatggcagattgaaaaggatctcattccat

SEQ ID NO: 40097 - DNA, 500 bp, Homo sapiens
  misc_feature 6, 23, 32, 40, 43, 45, 56, 63, 67, 81, 82, 92, 96, 106, 107,121: n = A,T,C or G
tggatnggggcccccttctcttnggcaagaanggcggagnacnanttgactactcncatacgngccnttgtttggatcggnntctagtcttnccgnttcttgaatnnctctgtgtgaaggngatatataatgaaaaggaattattacaaggtaaattggaccttcttagtgataccaacatggtaagactttgctatggatgtatacaaaaacctttattctgatggtattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagt

SEQ ID NO: 40098 - DNA, 469 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaag

SEQ ID NO: 40099 - DNA, 464 bp, Homo sapiens
  misc_feature 427: n = A,T,C or G
gttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggnttttgtcacttcatctcttcactaatggagatagctt

SEQ ID NO: 40100 - DNA, 181 bp, Homo sapiens
  misc_feature 181: n = A,T,C or G
cagtgaaattgacctgcccgtgaagaggcgggcataacacagcaagaccagaagacctcccttcaggtgccgggcgcaggaactgtgtgtgtcctacacaatggtgctattctgtgtcaaacacctctgtattttttaaaacatcaattgatattaaaaatgaaaagattattggaaagtn

SEQ ID NO: 40101 - DNA, 354 bp, Homo sapiens
ggaaatcccagtttataataggtaaaaatggcaacaacctaaaaccttttcaatagggaaatggagaaagatgctatgactaattccataaagtgtaactatatgcagcatgttcaaagaatcaaatatatctttactgcttccttgaaaagccattaagtaagaaaattaagatatggaacaaatgtaaaagtatgaatccattacattaaaacattatatgaatatgaatgtacatatgtgtgtagccactggggtaagaatggaagggcagggggaaacatggagggagaatatttccccatctttatacacagttgtaatgtctgaatttcttcaaataaacatttattg

SEQ ID NO: 40102 - DNA, 466 bp, Homo sapiens
ggagtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagagacttcaaatgaaggagaaaacaatgaagaatcgaatgaagatgaagactctgaggctgagaataccacactttctgctacaacactgggctatggagaggacgccacgcctggcacagggtatac

SEQ ID NO: 40103 - DNA, 471 bp, Homo sapiens
  misc_feature 10, 26, 67, 68, 69, 71, 73, 92, 130: n = A,T,C or G
gaggaaaaangaaactatttgcaaanaatgagatatgtaagaagtctgccaggctctgaactacaannngnanaaaactggcttgtgaagtnggttatatatagagagagtaatggaagtgatccggagnagctaggcagagaccacattatgaataatgaggggtctaccatcaagacttttctcaaagaggtgacagatagagtgccatttgacttcagagaaggaatgacctgagacctcatctgggctctcaagagctcttcttagaattcaagtctcccgtggaccagatgatttctcagtagaaagtgtagataccacacaatactccttgtatctttcgttcccaggatatgatggacgatatctgtcaggagcaatttctagagctgtcctacttgaatggagtacctgaaccctctcgtggacgtggggtgccagtgagaggccggggagctgcacctcctc

SEQ ID NO: 40104 - DNA, 466 bp, Homo sapiens
ggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtca

SEQ ID NO: 40105 - DNA, 238 bp, Homo sapiens
ggggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaagggtagcattattat

SEQ ID NO: 40106 - DNA, 404 bp, Homo sapiens
caatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaat

SEQ ID NO: 40107 - DNA, 208 bp, Homo sapiens
aaggtggaatcaatctaagtgtccatcagtggatggatggataaggaggatgtggtatatatccatagtggagtgctcttcagccctaaaaggaatgaaatcctgtcatttgcatcaacgtgggttgaactggaggtcattgtgttaagtaaggcaagctaggcacagaaaggcaaatatcccatgttctcgctcttatgtgagagct

SEQ ID NO: 40108 - DNA, 144 bp, Homo sapiens
gtacaggagcacctcctgtaatcccagctactcaggaggctgaggcaggagaatcacttgaacccaggaggcagaggttgcagtgagccgagatcacaccattacactgcagcctaggcaacaagagcaaaaaaactccatttc

SEQ ID NO: 40109 - DNA, 142 bp, Homo sapiens
aggggtgttgcaggagaagggagagttcaaggcaaacgcaaggactggacttagctccctaggtgccacagtcagatgccggacacggatttatatataaatatatatatataaatatattatacccactcatcacggccat

SEQ ID NO: 40110 - DNA, 334 bp, Homo sapiens
  misc_feature 7, 334: n = A,T,C or G
atcaagnacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtatn

SEQ ID NO: 40111 - DNA, 465 bp, Homo sapiens
gaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggccttttttttaaaaaacaaaaaccacaaaaattcccaaaccatacttgctaaaaatt

SEQ ID NO: 40112 - DNA, 458 bp, Homo sapiens
gaggcattgaggcagccagcgcaggggcttctgttgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagcagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgactaaaataatttgaaggcgatcttttaaaaagaga

SEQ ID NO: 40113 - DNA, 310 bp, Homo sapiens
atttaaaagtattggaattgttctttgatcagaatggaatcaaattagacatcaacaaaaggaaatttggggaaactacaaataattgaaaattaaacaacatatttctaaatagcctctgagtcaacaagaaatgacaaggaaactagaaagtatttttaattgagaatgaaaatgcattgtatcaattcatgagatgcagctacttagtgcttagaagaatatttgtagctttaaaaatgtctaggataaaagatctacaatcaacaatctttttttacttaaaaatctagaaatgaaaaataaatcc

SEQ ID NO: 40114 - DNA, 288 bp, Homo sapiens
aaccttggaagcaggaaaccctcctgcagaccctgccttacagagaagagaatacttgaaatatgacactcggggaattggtaacaccaggaggctgtttctactgtttgctgcatgatttgcagcttcaattggactactttttctaacaggaagaaatgagccttgggaataccaggacgaatatatatagtctacagactctgaaacaaagctgttataaaattattggatacaacttaaagtaaggggatagtctgtttttattagaagatgatccttctgtgt

SEQ ID NO: 40115 - DNA, 419 bp, Homo sapiens
gggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgt

SEQ ID NO: 40116 - DNA, 464 bp, Homo sapiens
cactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaact

SEQ ID NO: 40117 - DNA, 459 bp, Homo sapiens
  misc_feature 17: n = A,T,C or G
ggttctgttacaaagtnaggggaagaggtattactgaatttgtgagaatattttaagttgggaattactctttttatacaaaagacgatgatgattaggttcagaagcttgcctattataacctgctttgactcatagttgaagttccatattattcaaaaaagtttatggaaaataatattactaccaaactcaataaatgaaacagaaacgtaggatctctaagtgagaaatatttatttctttcatgctcaaatgcagattaattaaaggtaataagtgacacatggatgttcatatacattcagaaagggaacttggtgctttaaaaaattttagagcatatagcacaagccttcaaatctgttttcattttaaaatgtacagccctctttttttgatacaggtgtatcattaggactgactggttttacatttgttagccatatttaggattat

SEQ ID NO: 40118 - DNA, 159 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 40119 - DNA, 471 bp, Homo sapiens
ggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatca

SEQ ID NO: 40120 - DNA, 231 bp, Homo sapiens
aacctaaaaataaaataatgagtagtggtgatatgtataatttcacttttcattacatcttgaaagaaaacatgggtttttcattgttaagccagtttttttatagccttaagatgtaattcacatatcatacaattcacacgtttaagtatacaagtcagtggtcttcagtatattcagatttgtgcagccatcactactatctaatgttagaacattgtcatcaacccc

SEQ ID NO: 40121 - DNA, 340 bp, Homo sapiens
gtgctcataattgtccttgcctttccgcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaatataaaaattagcctggcatggtagcatgcgcctatagtcccagctgctcaggaggctgaggcatgagaatcgcttgaacctaggaggtggaggttgcattcaactgagatcataccacttcattccagcctgggtggcagagcaagactctgtct

SEQ ID NO: 40122 - DNA, 469 bp, Homo sapiens
ggcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagccactcctctgga

SEQ ID NO: 40123 - DNA, 408 bp, Homo sapiens
  misc_feature 13, 407: n = A,T,C or G
ggagcagataagnagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacanc

SEQ ID NO: 40124 - DNA, 384 bp, Homo sapiens
caaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattg

SEQ ID NO: 40125 - DNA, 130 bp, Homo sapiens
  misc_feature 36: n = A,T,C or G
gcacaatactgtggtgtgttgctgttctttcttttnaagcaccagtatgaatttgataaagtaaattgttgttctagcaggaagcagttaggggtcacaaaataaatagccatagaattcaaataaatcc

SEQ ID NO: 40126 - DNA, 467 bp, Homo sapiens
ggcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccgggaccagcccgaagga

SEQ ID NO: 40127 - DNA, 388 bp, Homo sapiens
  misc_feature 128, 176, 214, 266, 298, 332, 355: n = A,T,C or G
gaaaggagagaaggaaatgaaatggtagctagtagacggtgaatttaagcaagatttgttccctttcttccactatacgcctctaaggaaattaaaaaaaaaaaggcttgtttagtttggaatgtggngtaaagagagcaacaagagattgaagtcaaagaataggtaagtgagcnctgtaaggatctgcagagacagacagaaaaagtctgcntggagagtaaattgggaagccaattaaaaaattttggtagtccttgcgtganatgttggtagcttaaactaggatagtagttgnggaagggatgattattggttggatacagtctatnttttgaagatagagttgactgcncttaatgacgaataagaaatgaggggtaagaac

SEQ ID NO: 40128 - DNA, 163 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatc

SEQ ID NO: 40129 - DNA, 445 bp, Homo sapiens
ggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgagaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaac

SEQ ID NO: 40130 - DNA, 287 bp, Homo sapiens
ataaactagaataataatgcccttaatgtgagggtttgtaatggtgcttattaagaccaaagacttgttaaatgtatacaccaagtggtaatgaaatttctgtgactggcccacgcgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagttt

SEQ ID NO: 40131 - DNA, 355 bp, Homo sapiens
ggtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttattttttttataaatcaagacttctgtgtgctcttaaatatattaaaaacaatttacatttca

SEQ ID NO: 40132 - DNA, 289 bp, Homo sapiens
aaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 40133 - DNA, 468 bp, Homo sapiens
  misc_feature 6, 9, 393, 427, 439, 459: n = A,T,C or G
gatgcnganatatggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagccttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagccctcctcattgtntaaatgaggcctaaatgtgtgaagtgcgattttntgcttttgtgtnccccaccacccccattaccncaggtgcct

SEQ ID NO: 40134 - DNA, 326 bp, Homo sapiens
atttgtgtgtttgctacacaccaagcaccaccacatgcttttgaagttactgatgtttgtattctttatgttagctagtggatagaatactgaatggaataatattttggtctttgtgattagctgtgtgatgagacttttcaccttctctgttctctggctttagagccatacatttttgataacacgtatcactcacaaattttaaatagagttacaagaattgttgagcgattcctgaatagataatgaaagtggaattttcatttaaataagtaatagtgtgtcattattaagaagcagttactaaagaattacagtagttg

SEQ ID NO: 40135 - DNA, 296 bp, Homo sapiens
gttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagct

SEQ ID NO: 40136 - DNA, 246 bp, Homo sapiens
  misc_feature 5: n = A,T,C or G
caagnaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 40137 - DNA, 432 bp, Homo sapiens
gtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaaga

SEQ ID NO: 40138 - DNA, 466 bp, Homo sapiens
ggcaagtagcgtgcgtgcccttgtgagtttggagggtgccggtcagcggagccgtgcgatgtatttgaaaagcaatcagtccgaccttcccccatagattcatcctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgccctggatgtgtg

SEQ ID NO: 40139 - DNA, 476 bp, Homo sapiens
gtacacatgctcttacacaactctcgccccatttggtttatccctgtgtctccttaacaatccagatgttctccctcttcgttgctcagtcttactgaggaattgatgagccctccggaccccagggctccacttatatatcgctgccctagtcatcagagttggttttattcttgcttgaaatgaagcctgacttcagtgtctctgtctatttcagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaat

SEQ ID NO: 40140 - DNA, 439 bp, Homo sapiens
gaagaccaaccacattggcccacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagttatggcagagctttacaaataaaaaaaaaactg

SEQ ID NO: 40141 - DNA, 227 bp, Homo sapiens
gttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaactcagttccacaataaaatacaaaagtgac

SEQ ID NO: 40142 - DNA, 249 bp, Homo sapiens
gaaaccgtgctgaagatgaaggcatctctcagaggaagtttctggatggcaatgagctcaccctggctgactgcaacctgttgctaacgctccacatagtacaagtggtgtgtaagaagtaccagggggcccgggtgtcatggctcacgcctgtaatcccaacactttgggaggccgaggcaggcagatcacttgaggtcaagagttcaagaccagcctagcctacaaggtgaaactccatctctaccg

SEQ ID NO: 40143 - DNA, 214 bp, Homo sapiens
cgaagatgtaaaaaatatgtacaaaactcaaatagatgaacttttaagacaaagtctcagttaacttgtgaaaattgaattcccatcaaactgaatgtgctgtggctcatgcctgtaatcccagcactttgggaggccaaggcgggcatatcacctgatgtcaggagttcaagaccagcatggccagcagtttggtgaaaccccatctctactt

SEQ ID NO: 40144 - DNA, 480 bp, Homo sapiens
agctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaagtcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctcccttc

SEQ ID NO: 40145 - DNA, 109 bp, Homo sapiens
  misc_feature 72: n = A,T,C or G
aatctgtgaagtttctgtcattcgtccgatctgtgtgtgtagcatgtgctgaggaagcacgtgctgggctgngcctcagacagtgcatcaccgggcacccagaggcttg

SEQ ID NO: 40146 - DNA, 473 bp, Homo sapiens
gtgggaaatgaccttgcttttgagtgcaaaggccaattttatgattattttgagaccggatataatgaaagaaacaatgtaaatgaatcttggaaaaagtccttacggaaaaaggaggcttcaccaccaagtaacaaactgtgctgcagcaaaggaagtaaaatatgagccatcttctcaccgaactttgaagcatgcacagcatgatcagttagctctcgtaaattttattttgaatggattttgtagttttgtacaacagataaaattatgccatgaacatgccatgtcgttttaatgcctggagagcagattgcgtaaaacatctgtatagcaggcatcagcgagcttcttataaatgtggtgatttttaccaaggaaacgattgacttaatgcttaaaagtatatcatagttttcttacggaaaagatcagtagatgagattgggggacaatgtgcccttgcaatattt

SEQ ID NO: 40147 - DNA, 366 bp, Homo sapiens
  misc_feature 255: n = A,T,C or G
agagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccanatttaagaaagcgttcaagctcaacacccactacctaaaaaatcccaaacatataactgaactcctcacacccaattggaccaatctatcacccctatagaagaactaatg

SEQ ID NO: 40148 - DNA, 490 bp, Homo sapiens
  misc_feature 8, 9, 20, 34, 402, 406, 422: n = A,T,C or G
gtgggtannaaaacttcttnttcttaaatttacntactaagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcagtaaactgcatatcaacttcccacaaaagctgacttttttgggtctcttacatataaagtaggcattgagttgatttttttnggangtatctcatattgggncgaattcttctggtatggactcttgccttatatagaggcttctatttctcttaagtcagcatcaatac

SEQ ID NO: 40149 - DNA, 242 bp, Homo sapiens
  misc_feature 4, 9: n = A,T,C or G
tganacganacacactgctttttttgaaagctgattctcctgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtcaattaaaaaaaatgtggcctctt

SEQ ID NO: 40150 - DNA, 132 bp, Homo sapiens
  misc_feature 2, 35, 54, 62: n = A,T,C or G
tntattggccgggggaaaatggctgcctctaaaangggagccttttactagaanaaaggacnagagtaaacagctacatctcaaaacttgccagtttcactgttgaaactggtctggtgcagcaggaacaac

SEQ ID NO: 40151 - DNA, 494 bp, Homo sapiens
  misc_feature 8: n = A,T,C or G
gggccatngaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacgcagcagctgtatttgaagaaggtggtgatgtggacgatttattggacatgatataggtcgtggatgtatggggagtctaagagagctgccatcgctgtgatgctgggagttctaacaaaacaagttggatgcggccattcaaggggagccaaaatctcaagaaattcccagcaggttacctggaggcggatcatctaattctc

SEQ ID NO: 40152 - DNA, 260 bp, Homo sapiens
  misc_feature 4, 15, 30, 33, 54, 71: n = A,T,C or G
accnctttgttaaantctgcactttctaantantcaaaaagggaaatgaagtantaaatcaatttttgtanaatctgtttgaaacactgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctag

SEQ ID NO: 40153 - DNA, 182 bp, Homo sapiens
  misc_feature 18, 29, 30, 32, 37, 38, 62, 69, 84: n = A,T,C or G
cggcccggggggttgttnaaaaccctgcnncntgaanntaacaccactagtaacgtgggaantacctanaaaataacccaagantttctactttttgtaaattactactttctctactgtagattgtgtatgttatgtgtttttatggaaagctaataaattaaaggtacagtggtatcttg

SEQ ID NO: 40154 - DNA, 471 bp, Homo sapiens
cagtttccatctctgctacctagtgactttgtaaattacttggacaaggttgagcctctctgtaccttagtttcctcatgtacaaaagaaagttgataacaaaaagtatctgtctcaaagtatcagtctcaaaggatttttgttaatattaaactaattaatgcttgtaaagcccttaaaacagtctctggaacataataagtgcttatatgtttactgtcattatcattattttttccatccatgctattacttcacaaaatatatgatagtaatagggaacatatacttatccaaactaaaattgccccaatattcatgtgtttcttaaaatacctaaacatttatttctataaaaagaattggttaattcaaatcttgccgaatatcagaatttctccacaatttaagataaattgcaattggagatggggtactgatatatttaaaatatatgctttctaaaatttt

SEQ ID NO: 40155 - DNA, 481 bp, Homo sapiens
  misc_feature 12, 326: n = A,T,C or G
gtctcaaagaantctctgtaaacccggccctcctgttgtaccttaactttctgagtctttggaatgataatttcacctctcctaaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacggctgctgtgggctttttccagttcttcaccatccatttttataaaactcttattgttaaaaaaaaaagttactcanaatttcataaagccaaacacctgatttcaggaacacttgagatgtaagaaaattttatagggacctccaatcactaatcttcctattttttctctcaaagaaatgctgaagggaggaattcaggttgaatgaaaggaaatagtaacttacagcca

SEQ ID NO: 40156 - DNA, 147 bp, Homo sapiens
gtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtcta

SEQ ID NO: 40157 - DNA, 246 bp, Homo sapiens
ggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttac

SEQ ID NO: 40158 - DNA, 270 bp, Homo sapiens
  misc_feature 13: n = A,T,C or G
acaaagtcaagantaggcaagagttagagcaaaaacacagtgcatgaaaccccaggacactgtcagtcttgaattattgttcttgactatgtctgtctccaccactagactctctaatgctgaggactgtgatttatagagcctcacatggtgttttgcatgttgtatttactcaattaatgtttgctatatggatgaaacttgagaaacagaaacatcataattgttacttattccatagtcttgtctgtgctggcctcagtaataaag

SEQ ID NO: 40159 - DNA, 255 bp, Homo sapiens
atatcctgggacttcatgatgaattcctagatgggcaaaggtggattgaagacaaccttgatttcagtgtgaattcagaggtgtctgtgtttgaagtcaacattcgatttattggaggcctacttgcagcatattacctatcaggagaggagggaagaggaagaacgtctgagaaataaaattcgagctgatcatgagaaggccttggaagaagcaaaagaaaaattaagaaagtcaagagaggaaattcgagcc

SEQ ID NO: 40160 - DNA, 318 bp, Homo sapiens
tatggccgggacaaaaagtagaggcagctgcagccaccgcggggcctcagtgggggtctctggggaacacagccagacatcctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctggggtcggtggctgtctttccattaaagaaacaccgtcc

SEQ ID NO: 40161 - DNA, 229 bp, Homo sapiens
  misc_feature 5, 229: n = A,T,C or G
gaaantctggttgggcctggtgttagggttctttgtttttggggtttggcagagatgtgtttaagtgctgtggccagaagcggggggagggggggtttggtggaaattttttgttatgatgtctgtgtggaaagcggctgtgcagacattcaattgttattattatgtcctacaagcattaattaattaacacactttagtaagtatgttcgcctgtaatattgaaccn

SEQ ID NO: 40162 - DNA, 474 bp, Homo sapiens
cgggtgtgagtcttttagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatattatatgtcaatatttagtaaagcttttcttttttaatttccaggaaaaaataaaaagagtatgagtcttctgtaattcattgagcag

SEQ ID NO: 40163 - DNA, 473 bp, Homo sapiens
gaggaagcaaggaccccagactctttctagcaacccacggctctcaaggggactaatctcttcccaccagagtgagaactcactcaccactgtaggaaggcactgggcattaatctattcatgagggatctgcccccatgactcaaacacctgctactaggtcccatctctcaacactgccacattggggatcaaatttcaacatgagttttgtcagggacacaccccatccaaaccatagcaaacaggttgcaaatattggacaataggtagcacagaacattgatcctcaagagaagaacaaacagggtgagccctacaattgctccagcccaccatctacagagtatatctagactgcagtgaggggagggccaactcaaacagtcctctggtctccctgagttgagatgaagttgagaattagggggagaccaaagtggctagaattcccagggaagaataccagaaag

SEQ ID NO: 40164 - DNA, 470 bp, Homo sapiens
  misc_feature 11: n = A,T,C or G
gagataaaacntcgagctatggaataccctgggtgtgtgcaaatacactgtccaggatgagagccactcagagtgggtgtcttgtgtccgcctctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatatttgtagatgaactgaagcaagaagttatcagtaccagcagcaaggcag

SEQ ID NO: 40165 - DNA, 158 bp, Homo sapiens; identical to SEQ ID NO: 33266

SEQ ID NO: 40166 - DNA, 469 bp, Homo sapiens
atcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgta

SEQ ID NO: 40167 - DNA, 472 bp, Homo sapiens
tctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagaggggaaagaccattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcag

SEQ ID NO: 40168 - DNA, 208 bp, Homo sapiens
  misc_feature 174: n = A,T,C or G
caggcatgatggcatgtgcttgtagtcccagctacttgggagactgaggcaggagaatcgcttgagcccaggaggtagaggctgcagtgagccgagattgtgccactgcactccagtttggatgacagagaccttgtctcaaaacaaaaacaaaattagttaagatgatacatntttatgttatatggaacataacgttaaaaaattg

SEQ ID NO: 40169 - DNA, 472 bp, Homo sapiens
ggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattg

SEQ ID NO: 40170 - DNA, 470 bp, Homo sapiens
gtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgca

SEQ ID NO: 40171 - DNA, 473 bp, Homo sapiens
caatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaat

SEQ ID NO: 40172 - DNA, 178 bp, Homo sapiens
  misc_feature 9, 12, 31, 65, 78, 81, 82, 88, 90, 99, 135: n = A,T,C or G
acgaacctntanctattatggaccgggaaancaagctctagtgcagtcgcttgcataccaactgngatgagcctatgnatnntagagnancacgagagnccatttgtgctgaacaccatagatcaacactaattnacgtgtgacgacaacaagtaaactaggagaatgcccaggcctc

SEQ ID NO: 40173 - DNA, 471 bp, Homo sapiens
cttgcactctaaccaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatcttttgatgatacaatctctgcttttgccacaggtttgacattaacctagacgtttctgcccctgtgctcattaccctcccaaaacaatagttttttttaatgaattgaaacacaattagatccattcctgagttttcatttttaactatttactttggggtcaagttggtttctgcatcacaagggcattctcttacaaaac

SEQ ID NO: 40174 - DNA, 471 bp, Homo sapiens
  misc_feature 399: n = A,T,C or G
aaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggnatttgatgaagaatgaagtggcagcagaggaacccaatgctgcagttcctgatgagatccccccctctcgag

SEQ ID NO: 40175 - DNA, 473 bp, Homo sapiens
gtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatattttgcagttgtatattttacatttaaatattttaaaggtttgcatttgtatgcttaagacattgatttcctgttggtaagatgtatttttatcctcacaatttagatgtagctgctttaaatttatttgatgtatttcgacaggagtcgt

SEQ ID NO: 40176 - DNA, 190 bp, Homo sapiens
ggtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaactt

SEQ ID NO: 40177 - DNA, 287 bp, Homo sapiens
caagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaacgcaagaaatgaagaaataaatccttggctcacta

SEQ ID NO: 40178 - DNA, 123 bp, Homo sapiens
  misc_feature 3, 13, 22: n = A,T,C or G
cantcggcctttnggccggggncgctgtctacactattaatattactctgacactacagtgacaatttcatatggttcaaccttatagtaatgatggctcctcattgactgttacttacagtt

SEQ ID NO: 40179 - DNA, 162 bp, Homo sapiens
  misc_feature 3, 15, 33: n = A,T,C or G
atnaatatggtgacnctcccgggagcgggggancaccaggttgcctaaggagggggttgaaatgtgggtgtttgaaacaaaagtgtataaacaaatgaattgttgataacttagttattgacctggagactggtagcttattaaagaaactccgtgttactc

SEQ ID NO: 40180 - DNA, 409 bp, Homo sapiens
  misc_feature 2, 16, 79: n = A,T,C or G
cnccctgacttaaaantctctgtaaaacgtgtagtgtttcctaaaatctgtaactcgcattttaatgatccgctatttntaagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatatttgggttgga

SEQ ID NO: 40181 - DNA, 208 bp, Homo sapiens
  misc_feature 9, 31, 71, 76, 79, 94, 131, 137, 138, 174, 175: n = A,T,C or G
ggttaaacngagggcccaggatttgggaaanatgacacctacactgtatatcaagcctattggctgctcanctganatnctgtcctttctacanagatctgtgtctgactgccttaggcacatacaggccntcctgnncttggattatcactgatgtctaattcctattacagnnattttaatactggctgtgtgagagactccttga

SEQ ID NO: 40182 - DNA, 460 bp, Homo sapiens
caggtaagttagtagattatcacatgttaaaaaacactcatccccgacctttgggagtgactaaagagttgtttatatgtactcggtaccctcagtaacacctcccaacccccaaatatcactttccttcccacacacataccacatacatgaactcttttgttgattttacatttgatttacattggtagggattttttcattctaacctgtactggggacccagtcacttcctctttctccagcattatcggtcacttatttactccctcgccattagagaattgttgtgagttttttgtttgtttgtttgtttgtttgttttttggagacagagtctcgctctcgtcacccaggctggagtgcaatggcatgatctcggctcactgcggcctccccctctcaggttcaggggattctcctgcctcaccctcccaagtagctgggctgcttcccccac

SEQ ID NO: 40183 - DNA, 472 bp, Homo sapiens
tagcaaataaatatgagcaagttaagtgaaattttacttcgtagcagtacctagatgtttatgtcatcataattttaagcccctttttatacataatttttaattaacttattttttattgaatttttaatcttaacaagtgaacagttgtaaatattgttaaaattggctgcaagaaataaacactttaaatataacatccagaaaacaatattatatttgtgtgtattagcttcttggactcaacttgtgctaattcagtatacaatatttaataaaatattcaacattttctatacatttattaaagtgttgttttaattatgattgtagaagactataaatctttataattatttgtttgtaatttacccaattatgtatcaggccagacctcaagaaaaggagaaatattaggctaaaatatcaatgttttatttgtccaggaacttcagtctgtatcagtttgtat

SEQ ID NO: 40184 - DNA, 441 bp, Homo sapiens
  misc_feature 22: n = A,T,C or G
cttgtaaaaacctgaacccagnaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattg

SEQ ID NO: 40185 - DNA, 473 bp, Homo sapiens
attataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatat

SEQ ID NO: 40186 - DNA, 484 bp, Homo sapiens
  misc_feature 1, 40: n = A,T,C or G
nctgtacagtaattccttgagctagatgattactatggtnagttcccatgatttgcaaattctgtatttgcaaatttacccattccctaaattttatttgtagaaacctttaatcacccaacaggaaatgacactgttatgaattttgtgcgccagtatagggccttgttttccaattatgatattaagattaataacttataatgtttaagtaactaaatgaaatggttgggctatatatctgactatatcctaacccctgataaaagtgaatttttagatcaccttttctttatcagtacctcttcacttctctattaactaggctaactgtattgggaggttgaccatatacagaattacattttaaaatctccctatgttacctgtttatgttattggacatacacagtttggaatgtagacactgttaatattttcaattataagacagaggcattttttaaattagttggtttcagac

SEQ ID NO: 40187 - DNA, 471 bp, Homo sapiens
attgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagat

SEQ ID NO: 40188 - DNA, 282 bp, Homo sapiens
atactttattacattaaatgcattggtctgtctgcattttgaatggatcttttaactatgtttgatactgtaatttcttgcattgatcatttgaagaatattggttttctgaaacacacagatcatctaaatgttgatacatttccttatgtaatactgaaaacaatcacattattgacatcatcatcaatgtatttaagtattgagaggttgtcaggctcactgtggtgaatactagttattcaaaatcttgttgctttaaagtccgaatgttgtaattga

SEQ ID NO: 40189 - DNA, 139 bp, Homo sapiens
  misc_feature 14, 102: n = A,T,C or G
atcgtataataatnggcactgttttgagatcatgtcaaagataacaaagcatcagaagcctcttctgttgctgaagaaccaatcaacctaaactaatacttnatgaccacttttcccaaagagaaaacaaattcaggcg

SEQ ID NO: 40190 - DNA, 257 bp, Homo sapiens
  misc_feature 257: n = A,T,C or G
agcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagtaagatccaaggagaaaacagtttacatttatctccttgatatctatttccctaagttgcn

SEQ ID NO: 40191 - DNA, 470 bp, Homo sapiens
gagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagc

SEQ ID NO: 40192 - DNA, 472 bp, Homo sapiens
  misc_feature 20: n = A,T,C or G
caacaagctcagcgttttcngggcttcccagaggtctgtgcgactagcccctgtctatcaaaagttactagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagt

SEQ ID NO: 40193 - DNA, 356 bp, Homo sapiens
attctcaactggcatagatttgactatgagcctcttacaggtggtttacagagtataatactctattattttgtatttttttcttgagacggagtctcgccctgtcacccaggctggagtgcaatggcatgatcttgactcactgcaactgccgcctcccagagtcaagcaattctcctccctcagcttcccgagtacctgggactacaggcacgtgccactacaccctgctaatttttgtatttttagtaggtcaggggttcgagaccagcctggccaacgtggtgaaaccccatctctactaaaaatacaaaaattagctgggggtgggggtgggtgcctgtaatcccagttac

SEQ ID NO: 40194 - DNA, 190 bp, Homo sapiens
ggggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacct

SEQ ID NO: 40195 - DNA, 147 bp, Homo sapiens
aatccaagtatgacatagccggtatgctttcatgaatgtttttatgtagattttcctcccatgaacatgagtaaataaatctgtttcctgagtggattgtggttgcatttaaagctctgtaataattctaataaatttactctatag

SEQ ID NO: 40196 - DNA, 470 bp, Homo sapiens
  misc_feature 26, 470: n = A,T,C or G
agggataaatatagatgtaatttttnaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgcaccttttgtagttttatttgtattactagattcataccttgatggtaacgctctatctggttttggggggtttttcatgttttagcatttgtataaagaaactggn

SEQ ID NO: 40197 - DNA, 399 bp, Homo sapiens
gtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggtttgatggaaaataaacatcagtttct

SEQ ID NO: 40198 - DNA, 444 bp, Homo sapiens
catgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattaagaagactatcaaaatacatgtatgtttcaggatatttga

SEQ ID NO: 40199 - DNA, 196 bp, Homo sapiens
gtagggataggtttagcatgaaagcagtttgggcgtaagtctgttcaaattaaaaaatgataaagctttaaaagtggttaagacagctgcacctgtaatcccagcactttgggaggccaaggtgggtggatcctgaggtcaggagttcaggaccagcttggccaaggcggtgaagccccatctctactaaaaatac

SEQ ID NO: 40200 - DNA, 473 bp, Homo sapiens
  misc_feature 16: n = A,T,C or G
cagaaaagagagagtnaaagtccgctaaagccgactcatccctgaaggtcaggaaaattgttcgcatgccaaagtgtgaccttctgaggaccatatcaaggttgtacacttcaggagaaagatacttcattgaagtagcccagccatgtcaacaaagaaataaacaccagcaataagtagccttgcagaattttatatccaaagttgacataatatactatctaaaatatccactttcaataaaatattatgaaacatgcacagaaatataaaaatcagacccataatcaaaattgaaataaggcaataatatctgcctttgagggtacacagatgttagtcttctcagacaaagcttcaaagaaaatgctataaataagtttaaaaaacaaagggaaataatgtactttaaaaaattgaagaacagtatggtaacaatgtccttgttgaataatatcaagaaaaagagacct

SEQ ID NO: 40201 - DNA, 372 bp, Homo sapiens
gaatcttcctagtttagatcttcattaattcttttaagtgatggttttcatttttttcactataaatttcctattgggtgattaatagtaaagtaagtaaagataaaagattatttttattggcatttatcttatgcctacataaaatttgctttatcatattatcacaggtctacaaagtttttttctagtcgtttctaacttaagttcactagctgcacatgggcatatgtgcctgtacccagctactcagaatgctgaggtggagggattgcttaagtccaggaggttgagcctgcagtaaaccatgattaggccactgcactgagctggggtgaaagaatgagaccttgtctaaaaaaacaaaacaga

SEQ ID NO: 40202 - DNA, 376 bp, Homo sapiens
gaaaccgtttagactctcaacaatgtatttttctttaaatttaagactttgactttaaaaggcacattttattttcatgtgcgacagctaacataaagatgtttgcatttctttgctgaaatcagtgtataggttgtttgtaactaataaactcttgtggcagatgattgttgggccacagtcatcagttttggggattgtgtgagaaacccatagcaaagtatggattaaggacttgggtttctcggcactgctacatcctccaaaaccaacatgcctttctgcaaagagaccagagctacattctgcaggtgtctgttttctttgaggggaacattttaaggaaacttaaaagggaggaactgagcatttagga

SEQ ID NO: 40203 - DNA, 464 bp, Homo sapiens
  misc_feature 457, 463: n = A,T,C or G
ggacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctctcccatctgtctatctatctggctggcagggaaggaaagacttgatgttgggtgaaggaaagaagtgggggngggaana

SEQ ID NO: 40204 - DNA, 471 bp, Homo sapiens
  misc_feature 458: n = A,T,C or G
attgctcttggagccccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttgggggtaaagacacctggatcagactccaagggctgccctgagtctgggacttctgcctccatggctggtcatgagagcaaaccgtagtcccctggagacagcgactccagagaacctcttgggagacagnaagaggcatctgt

SEQ ID NO: 40205 - DNA, 464 bp, Homo sapiens
  misc_feature 42, 53: n = A,T,C or G
cggccggaaccgccatcttccgtaattcgccaaaatgacgancacaaaggganagaggagaggcacccgatattatgttctctaggccttttagaaaacatggagttgttcccttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtaccttgggttcaactaaagcgccagcctgctccacccagagaagcacactttgtgagaac

SEQ ID NO: 40206 - DNA, 450 bp, Homo sapiens
atcctctaaggagccacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggggaagggggcaaccccccagtagctttgcctgcttttataaagttgaacaaattgaatttagacattcaggctaacctgcctttcttagtactcctttgttggcatg

SEQ ID NO: 40207 - DNA, 301 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctat

SEQ ID NO: 40208 - DNA, 194 bp, Homo sapiens
  misc_feature 22, 34: n = A,T,C or G
cagacctggagtcccaaaagcnaaccgctctttnacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcc

SEQ ID NO: 40209 - DNA, 490 bp, Homo sapiens
  misc_feature 6: n = A,T,C or G
agtttnaactttcctagtagtcctactgcttcaggccaattttctccttgccctgcttagcctagtcacaatttccagttcttctctgtatcctgcagcagtgagttccaaacacttaatgctgtcatctcttcctgtgaaaaccaagaaataaaggttattataaggtataaataaagaacccagtgatttctcttggggtgtgtgtgtccatgtgtgtgtatattttacaagaggaaagttaaagatactaagaatgcctgtgaaagtaatcaggaaatggagaaaacttgttttccattctagcacctaatcctttggtgtggttttggcactagaaaacacaaaatatgtcctctgtgtctactaggaatgcctctcttcatttagtcctgcttgagtgctcatgatggaaaaatatagactgaaaacaggagcaaaaagtgttcatcctactcattccttgtggggtctctttgctttcaagaat

SEQ ID NO: 40210 - DNA, 320 bp, Homo sapiens
  misc_feature 15, 24: n = A,T,C or G
tatggccggggaacnacgcttttnatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacct

SEQ ID NO: 40211 - DNA, 155 bp, Homo sapiens
  misc_feature 2, 23: n = A,T,C or G
tntgctcttttttactcttgaantgtcacgtactgtctgattggcttgtagaattgttatagactgccgtgcattagcacagattttaattgtcatggttacaaactacagacctgctttttgaaatgaaatttaaacattaaaaatggaactgt

SEQ ID NO: 40212 - DNA, 436 bp, Homo sapiens
  misc_feature 7, 14, 30, 52: n = A,T,C or G
cgggaanctcggcnttatggccgagctaantaatcattgtgctgatattacntctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatggtaaaaagaatacaattcttttttacga

SEQ ID NO: 40213 - DNA, 492 bp, Homo sapiens
  misc_feature 10, 13, 23: n = A,T,C or G
gcgtgttgantcntgaaaagagnagtattaatctgaaagggatggtgatcctttgattttctaaatggttttaatgccattgcctttaattgtgtgagtgcgtgttgaatcattaaaagagaacattaatctggtcgtcccagccatattaatcagattaaagtcatcctactttgtgacctgataatgtttaaaaatggaaaattctcatggtggtgttcattcagtcatttattcaaaagataatcatcgtcctctgtataccaggcactgttctggacagtgggagatgtaatggtaaataaaataaacaccacctctgccctctcaaagtgtgtagcttagtgagaccacaagcaggtgtactgagactacacacctgggcgagagcacacagtaatgtgggcagctgaggaaaaggagggacacctaatccagccttggcaagctctcctaccttcgaagaatttatccagactccaacaacaaatc

SEQ ID NO: 40214 - DNA, 446 bp, Homo sapiens
  misc_feature 3, 11: n = A,T,C or G
agnactgaaantatttacttagtttcaaagtacctgtctactaaaataggtattaagtgttgtacaagggggaaaagaataacattacagtgaggaaacctggcagataccactttactcaggttggtcagatgattaaagtgaatgtcattggtaatgaggtaaattgaaatcacctgacaggatagtggaagacgaagacagcatcacttctgtgaaatccctgcccaaggtatgtaatcagaatcccatcatgaggcacacccaaatgagggacattctacaaaataactaccttgcaatcttcatagagtgaagattattgaaagtcaaggaataatgaggaactgttccagactgagggaaagaaaatatttgacaagcagatggtattcgtgcttctgaactgaattcttttgctctaataaaagacattttgggcacag

SEQ ID NO: 40215 - DNA, 227 bp, Homo sapiens
  misc_feature 6, 16, 32, 37, 52, 53, 59, 64, 75, 123: n = A,T,C or G
caaganacctgcggantgtctgctctatcccnttccnccctcagcggatgannaatctnaaganacctcccgagngtctgttcacttccccttccaccctcagctccaccctcagtggatgantaatctcaagaacacctcccgagtgtgtctgctcactccccttccaccctcagcggatgataatctcaagaaactaaggaagaataaataaataatataaaaat

SEQ ID NO: 40216 - DNA, 179 bp, Homo sapiens
  misc_feature 2, 3, 12, 26, 27: n = A,T,C or G
anncagtagagnctgctgtgaaagannctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtc

SEQ ID NO: 40217 - DNA, 298 bp, Homo sapiens
tatggccgggggaagtcttgctctgtcgcctaggctggagtgcaatggcacggtctcagctcactgcaacgtctgcctcctgggttcaagcggttctcctgcctcggcctctggagtggctgggattgcaggcacccgccaccatgcctggctaatttttgtattttttagtagagatggggtttcaccatgttggccgggctggtctcgaactgctgacctcgtgatccaccctcctcggcctcccgaggtgctgggattgagggatgagccactgcgcccggccgagtctttaaag

SEQ ID NO: 40218 - DNA, 205 bp, Homo sapiens
  misc_feature 24: n = A,T,C or G
tgtcagcagaggtcgcctccagangaggtgctgtggagactgagcgcatagcacccttaaaatcctgggaccagggcttctccacgggtaagcttaatgcaagtggagcagtgatttccagctagtgccaggcccaaggtggatgcactgtcaccttagttggattgctttttaattacctcatattctgttaaaaatcatattt

SEQ ID NO: 40219 - DNA, 202 bp, Homo sapiens
  misc_feature 13, 42, 44, 50, 92, 161, 165: n = A,T,C or G
ggtgaaacctccntctctactaaaaaaaaaaattagctgggngngggggngacacctataatcccagccattcaggaaggctgaggcagganaatcgcttgaacccgggaggcggaggttgcagtgagctgaaattgtgtcactgcactatagcttggganacanagcaaactccgtctcaaaaataaataaataaataaat

SEQ ID NO: 40220 - DNA, 482 bp, Homo sapiens
gaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagtggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctgggtggtgcctgctgtttgaaaccgccctgctatcttctggcttt

SEQ ID NO: 40221 - DNA, 437 bp, Homo sapiens
  misc_feature 13, 31, 45, 55: n = A,T,C or G
acagcagactcantgagtctgttaaaaaaantttttaacacttancttttttganttaaagtttattaattgaaacagatgcttttttgatagttcttaagtttcttgtggttttaaagtacaaaatgctcttcaaaatagcataagattaaaaagggcattgtacttggaaggatactgccctctagtctaatggaatcaaaggggaaaagaaatgaacacccacgcccccagaagagtagaaacccaagtggtctcttggcacttcctgtatcgctccattcctgtctttcaccctgctctctctgggtcaaataagtcaagtgtgtaacccccgtgcagttgtttttggaagaaacatgggagcagatataaaattaggatgtttcatcttgaggtgacagaagcaaaggacagttctgcgagaagggtatatg

SEQ ID NO: 40222 - DNA, 424 bp, Homo sapiens
  misc_feature 4, 414: n = A,T,C or G
gagngcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcggcagacatctggaggacctgttgatgctagttcagagtatcagcaagagctggagaggggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtnaaatttgtca

SEQ ID NO: 40223 - DNA, 419 bp, Homo sapiens
  misc_feature 2, 7, 328: n = A,T,C or G
tnggaangacgttggtgttgaggttagcactacgtattcaaggacagtaactaccctggctcccgaagttttgccaaaacctcggatgcgtggccttctggccaggcgtctgcgaaatcatatggctgtagcattcgtgctatccctgggggttgcagctttgtataagttttcgtgtggctgatcaaagaaagaaggcatacgcagatttctacagaaactacgatgtcatgaaagattttgagggagatgaaggaaggctggtatctttcagagtgtaaagtaatcttggaatataaaagaatttcttcaggttgaattacctaanaagtttgtcactgacttgtgttcctgaactatgacacatgaatatgtgggctaagaaatagttcctcttgataaataaacaattaacaaat

SEQ ID NO: 40224 - DNA, 479 bp, Homo sapiens
acacaagtaacatctaccacaactcaagataccacaccattcaaaattactactcttaaaacaactactcttgcacccaaagtaactacaacaaaaaagacaattactaccactgagattatgaacaaacctgaagaaacagctaaaccaaaagacagagctactaattctaaagcgacaactcctaaacctcaaaagccaaccaaagcacccaaaaaacccacttctaccaaaaagccaaaaacaatgcctagagtgagaaaaccaaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcagggtggtgctgaaggagaaacacctcatatgcttctcaggccccatgtgttcatgcctg

SEQ ID NO: 40225 - DNA, 256 bp, Homo sapiens
ggagttttatatccaacatttcttactgatgataatgtaacttcttcccctttggtttaaaaatgactactttagagatacctcctagttattagaggtccctttctatatggttcaaaagagattacgtagagaagctaaccactcaaagctatcctttgtcagatatcctatatatgtgatatatttcattttatgaaaatgtctgaaagtatattaatagttattttcttttttttttcctttttaattatag

SEQ ID NO: 40226 - DNA, 121 bp, Homo sapiens
  misc_feature 1, 17, 29, 36, 37: n = A,T,C or G
ngccggggactctgagntgccacaggacntccagannggttcctctagcaggtctttgaatgtgttagtgcaggtttgaactcagagaagggtaagaggtaaaggtttaggagtcatttac

SEQ ID NO: 40227 - DNA, 281 bp, Homo sapiens
aggagatagggatattggcccctcactgcagctgccagcacttggtcagtcactctcagccatagcactttgttcactgtcctgtgtcagagcactgagctccacccttttctgagagttatttacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatgg

SEQ ID NO: 40228 - DNA, 172 bp, Homo sapiens
ctctactaaaaatacaaaaataagcttggtgtggtggtgcacgcctgtagtcccagctattcgggagactgaggcaggagaatcacttgaaccagggaggtggaggttgcagtgagccgggatcgtgccattgcactccagcctaggtgacagagcaagactctttctcagt

SEQ ID NO: 40229 - DNA, 473 bp, Homo sapiens
agctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggccccgagcaggaattcggtgtggacatagggccggtctgcttcttgtaaaaacctgaacccagaaacaacacaatccgttgcaaacccaaaggacccaagtactttccaatctcagtcactctaggactctgca

SEQ ID NO: 40230 - DNA, 217 bp, Homo sapiens
aggggaatggtggattaggttacttacagagtgaatgaaaacagaagagactctgggaggaaattctgggaagtcaccgtgatggttatgtagagtatgataaatatcagtataaaaagtgtcttaaactacccttgacttaacagtcattattcattcattcaacaaatatttaggcaccttctaaattccagacactgcattaggcactagagat

SEQ ID NO: 40231 - DNA, 101 bp, Homo sapiens
  misc_feature 2, 10, 29, 48, 54, 56: n = A,T,C or G
tngccgggancttgcatgtggatcaaccntcgctttattggctgaganatgaancntattgttgaaaggtaatttgagagaaatatgaagaactgaggagc

SEQ ID NO: 40232 - DNA, 385 bp, Homo sapiens
  misc_feature 384: n = A,T,C or G
tatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggaacaaaaatagattttctagaaactgcagactcctgtgattggagcagtatacaaagtacagcaacatcagactagatctcacctgaggtgctgggtgagaaatcttagggccagatgggaagagggccctgtgtataaagacattang

SEQ ID NO: 40233 - DNA, 471 bp, Homo sapiens
agatacgccattgcactccagcctgggcaacaagagcaaaattctgtctcaaaaaaataaataaataaataaaataaaataaaatttggctatagattgattctcaggagttcgcaaactttctgttaggggcagataataaatatttgagattttgcagcctgtactatctctgtggcattcaattctgactttttagtgcaaaagcagctatacacagtaagtcaatgaatgagagtggctgtgttccaattaattttatttgtaaacactgaaatttgaatttcatatatttttatgtcacaaaatattttcctttaaaaaattgttttcccaaccattaaaaatgtaacaatcattcttaggttgcaggccataaaaaattaggcaggctggatttgacccatgagccacagtttcctaactcctgttctgcatagttaccttcattataaatattttcaataattt

SEQ ID NO: 40234 - DNA, 274 bp, Homo sapiens
cgcagtggttacggctgtaatcccatcatgttgggaggccgaggtgggcagatcacctgaggccaggagctcgagaccagcctgcccaacatggcaaaaccccatctctactaaaaatacaaaaactagccgcctgtggtcatgcgcacctgcaatctcagctacttgggaggctgaggcacaagaatcacttgaacctgggaggcagaggttgcagtaagccaagattgtgccacggcactccagcccgggcaacagagtgagactacgtccc

SEQ ID NO: 40235 - DNA, 464 bp, Homo sapiens
  misc_feature 417, 420: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatggaaggtgacttaaacagcttaaagtttagttaaaagttgnganggtgattaaaataattttggaaggcgatcttttaaaaagagatt

SEQ ID NO: 40236 - DNA, 477 bp, Homo sapiens
  misc_feature 372, 373, 460: n = A,T,C or G
gcttagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacgacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaanntgtggtcacaccaacaaccctgcgtcccaagaagagggcaataaaagggggggttctttcctttggaaagggcagcctcctgcccangccccgtggccctggag

SEQ ID NO: 40237 - DNA, 344 bp, Homo sapiens
  misc_feature 19: n = A,T,C or G
attgcaaacccagcaagantggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaat

SEQ ID NO: 40238 - DNA, 133 bp, Homo sapiens
aggaaggtattttctgacttgcaatgcagctagatgtaaaattttattttatcatactagaaagccttgactagaaaaatgaataaatattgagggtttcctgtccatatctggcttgcatgtgccagaaagc

SEQ ID NO: 40239 - DNA, 210 bp, Homo sapiens
  misc_feature 6: n = A,T,C or G
ctgacncacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttccac

SEQ ID NO: 40240 - DNA, 471 bp, Homo sapiens
acaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccggggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcgggtgtggacatagggccggtctgcttcttgtaaaaacctgaacccagaaacaacacaatccgttgcaaacccaaaggacccaagtactttccaatctcagtcactctaggactctgcactgaatggct

SEQ ID NO: 40241 - DNA, 471 bp, Homo sapiens
  misc_feature 427: n = A,T,C or G
gtgatttaaaaaattaaacatttgtttagctcatgaatccgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaaaggaggcaacctcataccagcccatgggtctaccgtttaattttcagaaatttggcaagctgattgttaacacagctgttgttnaattttatgtacttggaattaaaataatttacattaaaacaaag

SEQ ID NO: 40242 - DNA, 471 bp, Homo sapiens
  misc_feature 2: n = A,T,C or G
antaccgtatgttaatcctttggtgagggctagaattcttctgacatctttaattaaaattatattccatctatatggaacatctatatggtaacatacataaattttaatctgaaaggcatatattaaactaggatttgatttttttcctattgttattagccgtacttgctagtgggtggttgtcatcataacacattttctttgtcaaaggctcaaggtagcttgttggggccaggctgggctcaagtcaagtaaggtgttccatgtggcatccagatgttccctttcattactactggctgcctttggaaagctagctccaattttctggagctgttttctgaatattccccacacacatttcaaatagtgtagcttttaagctacttccatcttcgggtgttccagcagtgagaattttggatacacttacttcaagccgagtaagttaaagtacctccaattcag

SEQ ID NO: 40243 - DNA, 471 bp, Homo sapiens
ctccttgtggaaatttgagaccgcaagtactatgtgactatcattgatgccccaggacacagagactttatcaaaaacatgattacagggacatctcaggctgattgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatgggaaagtcacccgtaaggatggcaatgccagtggaaccacgctgcttgaggctct

SEQ ID NO: 40244 - DNA, 261 bp, Homo sapiens
  misc_feature 14, 235, 251, 256: n = A,T,C or G
gtgtgctcttggtntttccttcttgtgtgtgaaaatgtttgggaacagttctttgtgtagacaaagtggaaacaatttttttaaatggaagaggatgttttcactgtggaagagatggtagacagggcattcacaagtttgacctcccaaccaggctctgaaaaatctttatgaaccagctttccaccattcgtctttttttttttaatgggtccatagcttgaacccaggaggngggaggttgtagtganccacnattgt

SEQ ID NO: 40245 - DNA, 141 bp, Homo sapiens
  misc_feature 10, 18: n = A,T,C or G
atagctgatngttttttncctggaagcatttgtttctactttgatatgactgtttttcggacagtttatttgttgagagtgtgaccaaaagttacatgtttgcacctttctagttgaaaataaagtgtatattttttctat

SEQ ID NO: 40246 - DNA, 315 bp, Homo sapiens; identical to SEQ ID NO: 28837
  misc_feature 4: n = A,T,C or G

SEQ ID NO: 40247 - DNA, 183 bp, Homo sapiens
aaagactttgcagcctaatgcatgtgtcatgctaaaatagaagtagttagacatgtggagttaaatatggtgatggtttctcagatgattaaaatgactgccaccaggttaaggtagttacaaagcagctttctgtaatggcagcagagataataaactgggcaacaagggaggaaccaattt

SEQ ID NO: 40248 - DNA, 231 bp, Homo sapiens
  misc_feature 5, 22: n = A,T,C or G
aagantaaaaaggaaaatgatnatctccttctatagcatttgcagattcaagggggagaggtagatgctgagatcaaaatgacagttgttacttattttcccaggtgctgttagtataaacattgtttcctcttcacccctgctaactacctctttaaagtatttctaccaaactgtgaacccaatctcagggaaaagaaattaaaaagtaatataaattctgcatatatt

SEQ ID NO: 40249 - DNA, 362 bp, Homo sapiens
  misc_feature 23, 43, 358: n = A,T,C or G
agtcctcaggctgtaagcaagantacagcactggcccttggcngcgtcctaccctgcccaactccaaggactgggtatggattgctgggccctaggctcttgcttctggggctattggagggtcagtgtctgtgactgaataaagttccattttgtggtcctgcagcctctttctgtgacagagaatggctttgcgctgcccccaggaaaatggtaatgagagtaggtaggccggggctaccaacgggagatgcagtttatttacaccagcagccatgggggcagagggaatacacagcgtttacaaagttagctacctgtacagaatggattacatatgcaaaaataaaaatctcangaac

SEQ ID NO: 40250 - DNA, 441 bp, Homo sapiens
  misc_feature 324, 334: n = A,T,C or G
ggaggagactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtaagggttttggggtctggagctgtattagtatgtcaaactgccagtaagccagcccctcaccctctgatagatattcctttaatgcaccagacttcatgtttgataaatgattaatggntgaaaattgnttctcttcttttgtgttttcccagttaatagatggtcactgtttccacaatgttttatactttcagctttttgtaacttaactataattacttaattttattttttt

SEQ ID NO: 40251 - DNA, 397 bp, Homo sapiens
aacctttagatgccatgactctggaatgccagagtagtgcctccttacatcaaatctaatatatgaaatctctttaaatgctctttgaagataaagtatttgatgggttggattacaggcgtgagccccgtgcccagccaaaaagaaattttttaagaccagtaattctctactgtatggtttgtgggcctctgggagtctgcaaggtgaagactgattttgttgttgttgttgttttgagacggagtctcgctctgtcgcccaggctatagggcagtggtgcaatctcacctcactgcaagctccgcctcctgggttcatgccattcttctgccccagcctcccgagtggctgggactacaggcgcccgccaccaagcatggctaactttttgatt

SEQ ID NO: 40252 - DNA, 498 bp, Homo sapiens
  misc_feature 5, 9: n = A,T,C or G
ggatngggnaatatcctttgcctatctgttttaatatctattaacgacttgccccaattattacttgccccaattattactgtgacatttgccaaatgatgattttctatttttatcatttcttctacatatcttaatttatatttattaatttatttcagctgcaggaaagagctgtatcaactctctcatttatttgtttatttatttacttaaatcagtagacaatggattttttttcctatgggttacagttcattagtattaggatggcacaaaagcagtcatgattactttcaatggcaaaaccatgattacttttgcaccaacttaatattataaattttattgcttaatttgcttagttttattttctctgtctcaactctggaatcagccatttctccaaggagccctgattcatttcattgaaaatgatatttagaagccataatatggttgctaggtgtcctcatttctactgagagattattcctg

SEQ ID NO: 40253 - DNA, 470 bp, Homo sapiens
  misc_feature 409: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaaggtgacttaaacagcttaaagtttagttnaaagttgtaggtgattaaaataatttggaaggcgatcttttaaaaagagattaaaccgaag

SEQ ID NO: 40254 - DNA, 295 bp, Homo sapiens
gggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaagtgtttttaaaaaggtcatatattttttgctacttttgctgttttatttttttaaattatgttctaaacctattttcagtttaggtccctcaataaaaattgctgctgcttcatttaaaaaa

SEQ ID NO: 40255 - DNA, 471 bp, Homo sapiens
  misc_feature 212, 442, 469: n = A,T,C or G
gataataaaaataaaggaaatgtggccaagcgtggtggctcatgcctgtaatcccagcactttgagaggctgagggggaaggttcacttgagaccaggagttcaagatcagcctgggagacatggtgagaccccatctctacgaaaaaaaaaataaattacccaagcatgatgaggcatgcctgtagtcgcagctactcaggaggcttaggnggtaagatcacttgagcccagaaggttgagactacattgagccacgatcacaccactgcactccagttcagcctgagcaagagaacaagatcccatctcaaaaaaaataaagacaaaggaaatgctaaatttcagaggttagtaaaaataaaaacgcatttttttcaagttaaagtcacagacatcccctgaattctacctgtactcacctctatagaccccaggctaanaatctttggtcgacagaaaaatctgcnga

SEQ ID NO: 40256 - DNA, 303 bp, Homo sapiens
aacctaggctgggtgctatggctcacgcctgtaatcccagcactttgataggttgaggtgggaggattgcttgagtccaggagttcgagaccagcctgggcaacatagtgagacccccccgcatatctacaaaaaatgcaaaaattagctgggcatggtggtgcacacgtgtactacatttatagttccagctacttgggaggctgaggtgggaggattgcttgagcccaggaggtcctggcaacggtgagctgtgatcgtgccactgcattccagcctaggcaacagagaaagatcctgtct

SEQ ID NO: 40257 - DNA, 470 bp, Homo sapiens
  misc_feature 303, 356: n = A,T,C or G
gaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttngaatgtctcttcaatctccagaaagtctgaagatgatgagaaactgaaaaagnaggaaggagcgatttggggattgtcacaagttcagctggaactggaaccacagaggatacagaggcaaagaagaggaaaagagcagagcgctttgggattgcctgatgaaagag

SEQ ID NO: 40258 - DNA, 133 bp, Homo sapiens
aatctagtttacagaaaaatcttgtgctagaatactttttaaaaggtattttgaataccattaaaactgctttttttttccagcaagtatccaaccaacttggttctgcttcaataaatctttggaaaaacac

SEQ ID NO: 40259 - DNA, 164 bp, Homo sapiens
attgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaact

SEQ ID NO: 40260 - DNA, 497 bp, Homo sapiens
  misc_feature 2, 18, 40: n = A,T,C or G
cnccctgggaattcggcnttatggccggcagacccaaggnactatgaagttgatgctactctgaagtctctcaacaaccagattgagacccttcttactcccgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatatatgttagaaaggagtgacttccaaggaaatggctacccaacttgccttcatgcgcctgctggccaactatgcctctcagaacatcacctaccactgcaagaacagcattgcatacatggatgagggagact

SEQ ID NO: 40261 - DNA, 255 bp, Homo sapiens
actgccgaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttg

SEQ ID NO: 40262 - DNA, 158 bp, Homo sapiens
gactcttagcggtggatactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgcc

SEQ ID NO: 40263 - DNA, 146 bp, Homo sapiens
gtgtttattgaatggtgattgcctgctttatttcagaggaccagtgctttgatttttattatgctatgttataactgaacccaaataaatacaagttcaaatttatgtagactgtataagattataataaaacatgtctgaagaca

SEQ ID NO: 40264 - DNA, 498 bp, Homo sapiens
  misc_feature 2, 13: n = A,T,C or G
cncctatagctgngatggatcgggggtccccatgttcttttagcttcagcctttaaaatactagtcattatttattatttcttcaaaagcccatctctaattgtctccttagggagtttttgagttcacattgacattaattgtcactaactgtcagcagttggcattaaccagactctattttaggattaaatccacctgatccacctgcactatcagaacattcaggacgcgactcaggctgcagctcagagggctccaccggtggccctagacttgcatcaagctgctgccattgccactgcaccagcttgtatgccaggttaccacatagtcctatgtaaccatgtgggccgctgtagagtaattcccctacttttgtcccccacttcctcaggtagaggctcgtagacattacattggatgagcaggcagctcagcttggtcagagccagccgtctgctccacccactttgtcctatcacagacccagtcgca

SEQ ID NO: 40265 - DNA, 165 bp, Homo sapiens
gctgaagttgctctgtacccatgaactcccagtttgcgaattatagagataatctattttgttacttgcacttgttattcgaaccactgagagcgagatgggaagcatagatatctatatttttatttctactatgagggccttgtaataaatttctaaagccgc

SEQ ID NO: 40266 - DNA, 274 bp, Homo sapiens
  misc_feature 5: n = A,T,C or G
cagtnagaaaggcaaaccgagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaccccat

SEQ ID NO: 40267 - DNA, 442 bp, Homo sapiens
  misc_feature 23: n = A,T,C or G
gtttgttttctttctaacagtcnggccgctctgctgcaggtcagctggagtttattgaaggtccactccagaccctgttttcctggctatcaccagcagaagctgcagaacagcaaagattgctgtcttctccttcctctggaagcttcttcccagaggggtagccacctgatgtcaaccagagctctcctatatggaggtgtccattgaacccagctggggaggtgtctctcagtcaggaagcacctgggttagggacccacttgagcaggcagtctgtcccttagtagagcacaagttctgtgctgggagatcttctgctctctttcaagccataggtaggcacatttaagtttgctgaagctgcacccatagccatcccttactccaggtgctgtgtcccaggggagatggggaaattttatctataagcccctaactg

SEQ ID NO: 40268 - DNA, 498 bp, Homo sapiens
  misc_feature 5, 18: n = A,T,C or G
aatgncaaacagaatgantagagtaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcgcactgagcatggtcagggcattggtcagagggacagagcaaggaatgcatcctgagcccacagctttgaccactgtgatccagaagagaggtgcactacgtgggaagtgctgattccacagcatgcagcctggtagggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtccca

SEQ ID NO: 40269 - DNA, 297 bp, Homo sapiens
  misc_feature 10: n = A,T,C or G
gtttagaatntacagcccttgatataaagttatttaaatctaaactgccacaataaatgttgaatgaatggttatttgtttatattataagttttattttctctgcttattggagaaccattcaccattgttctaattaattaataaatagacaaacttcttatatctctgccttctgaccatcaaactgaataattttaattcaacaggtcttattttcatttcctttgaaattttcctaattgccttcctttccaagtttaccataggtgccttgattcctttctggaataacag

SEQ ID NO: 40270 - DNA, 470 bp, Homo sapiens
gctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgc

SEQ ID NO: 40271 - DNA, 271 bp, Homo sapiens
  misc_feature 9, 22, 27, 28, 35, 37, 38, 49, 55, 63, 85: n = A,T,C or G
tgggtggangtgggtctggganggacnngggggancnntttttaagacnaaaganttctagangcctctgaaatgaaaaagaganttacttagcctccacactcgtctaaacctctctggggaaaacactaattagatggcatttgaaaattatgtacatcatactctactttattatgcagtatcaagaaaaaaacatgaatgcagttagcagccatggaaaccctggtaaaatttgacaatacttgtatttctacctcttgcaacctcc

SEQ ID NO: 40272 - DNA, 163 bp, Homo sapiens
  misc_feature 12, 15, 106, 162: n = A,T,C or G
aactgtaaagangancactggtttttttttcccctgcttccacccttctgatgattttgtattttatttttaatttacaaataataattgtatatttatggggtanagtgtgatgttttgatatatgtttacaatgtggactgattaaatcaggctacttanc

SEQ ID NO: 40273 - DNA, 471 bp, Homo sapiens
tgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccctctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggggtctggacaaagtgccaaaggatcttccccctgaca

SEQ ID NO: 40274 - DNA, 206 bp, Homo sapiens
  misc_feature 2, 3: n = A,T,C or G
tnnattggccgggggccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcg

SEQ ID NO: 40275 - DNA, 377 bp, Homo sapiens
  misc_feature 4: n = A,T,C or G
tatntaacaaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatattttttttgcattgactgctgagagctcctgtttactaagcaagcttttgtgtttattatcctcatttttactgaacattgttagtttttgaggtaatggaaacccactttttcattgtaatgactttgggggcttttgttagtaag

SEQ ID NO: 40276 - DNA, 472 bp, Homo sapiens
agccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgtctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttg

SEQ ID NO: 40277 - DNA, 330 bp, Homo sapiens
  misc_feature 3, 12, 90, 134, 135, 212, 310: n = A,T,C or G
tcnaactgacgntaaagtgagtctacctgtggagaggaccttccaaactgtggttaccctcagcttctctcactgcccaacactcagaanaacctgacggctactgacttacctactgccctttttctaaaganncaactacctactaacacttgactgtgccctagtagaaccagcaagagcaattactacttcgttctgggcagaccttntccaaagtctggtacaactgtccttagactgatgagcaaaggaggagtcaactaatgaaagaaatgaataataaattttgacactgaaaaacattttnttaataaagaatattgacat

SEQ ID NO: 40278 - DNA, 129 bp, Homo sapiens
  misc_feature 32, 45, 47, 64, 66, 87, 107, 117: n = A,T,C or G
ggcaggctcctgtaatcccagctactcaaaangctgaagcagganantcacgggaacccgggangngggaggttgcagtgagccaanattgcactactgcattctancctgggcganaagtctgtccct

SEQ ID NO: 40279 - DNA, 242 bp, Homo sapiens
  misc_feature 4, 26, 34: n = A,T,C or G
gaancgcaaacttcgtacttttctantgaagacngcgtatggccacagaagttgctgctgacgcctctgggtgaaagaatggaaggtaaaagttgacaaattgttgcagggttatgtggtccgaatcagtggtgggaacgacaaacaaggtttccccatgaagcagggtgtcttgacccatggccgtgtccgcctgctactgagtaaggggcattcctgttacagaccaaggagaactggag

SEQ ID NO: 40280 - DNA, 497 bp, Homo sapiens
  misc_feature 13, 15, 41, 42, 43, 44, 45, 65, 487: n = A,T,C or G
aacctcggccccncngggcccggggtcactcaactcctacnnnnnctagtctactgtgactaganaaaaccctacctaccttttttcctactgtttgtttagcgactttagcaaaatgttttcctactaactctcctctgtttacctagaagacaggttaaggaaatactacttacttattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagttagtagttaaatctgaatgtgtatggacaaaaatatttaattgctcagtaaactgcttaacttcaaagatagttattgaccttataaataaatatttcaaaattttgattccggaagactaagtctggacgtagacattataatgctacaaaagnaagtttgatc

SEQ ID NO: 40281 - DNA, 431 bp, Homo sapiens
  misc_feature 14, 24, 394, 400, 407: n = A,T,C or G
aacgcctgtcttcnaaccaaagangcaaggtgaaagcagcagttgctgatacagaagctgcagcaggttatccagaagatctagctaagatcactgataaaggtgtctacactcaacaacagattttcaatggagatgaaatagccttttgttggcaaaagataccatgtaggattttcctagctagagagaagtcggtgcccggctgcaacgcttcaaaggccaggctgactgtcttgttaggggcgaatgcagctggtgactaagttgaagccagtgctcatttaccattctgaaaatcctaaagccttaagaattctgctaaatctgctctgtgctctagaaatggaacaacaaagtctggatgacagcttatctgttaacagcatggttnctgagnttttttnaagtccactgttgaggcctactgc

SEQ ID NO: 40282 - DNA, 209 bp, Homo sapiens
  misc_feature 15, 75: n = A,T,C or G
agagcaccaacttcntcaccttcaggcttcagtgtactgggtaacactgaccctgtcgttctgcttgagacaganattagattttttttggaatttggatctttcatctgagttctttttcatgggcgggtcggggtcagtatcctgtttgttattgttaaatttgtatgaaccttagaaaagttattaaagtgccaaagaatgttcga

SEQ ID NO: 40283 - DNA, 500 bp, Homo sapiens
  misc_feature 3, 10: n = A,T,C or G
agnttcggcnacgtcaaatccttttctaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatgggggagatggtacccagaacgagtcacacagcagcttttcttagtgacactaaagatcgaggccctccagtgcagtcacagatctggagaagtggtgaaaaaggtccccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaac

SEQ ID NO: 40284 - DNA, 277 bp, Homo sapiens
  misc_feature 2, 4: n = A,T,C or G
tntntggcccggggggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgc

SEQ ID NO: 40285 - DNA, 500 bp, Homo sapiens
  misc_feature 15, 22, 55, 77: n = A,T,C or G
aaccctgtgaagacncacagantggccagggcagagtatcaacgaattttcagangcctcagttcttctccagatgntgagtctgtttactgcactactgaaaaatacaacgttatggaacatagacataatgatatgcattatgaatgtatgactccttgtcaagttacttcagactcagataaagagaagacaatagcatttcttctaaaagaattggatattctcagaacaagcaataaaaagcttcagcagaaattggctaaagaagataaagaacagagaaaactaaagtttaagctggaactccaagagaaagaaacagaagctaaaattgctgaaaagacagcagctctggttgaagaagtgtattttgcgcagaaggaacgtgatgaaagctggttatgtctagactgcaattagccattgaggagagaggatgaagcaattgcacgagccaagcatatgggaaatgtctctaaaagtgctagaaaatatta

SEQ ID NO: 40286 - DNA, 130 bp, Homo sapiens
  misc_feature 4, 39: n = A,T,C or G
gatnctgttaccctatcaagctgaaaatgtcaccactantctggagatttcgacgtgttttcctctctgaatctgttatgaacacgttggttggctggattcagtaataaatatgtaaggcctttctttt

SEQ ID NO: 40287 - DNA, 442 bp, Homo sapiens
  misc_feature 3, 8, 49, 71, 98, 118, 126, 133, 161: n = A,T,C or G
acngacgngaactttgtcaccagttaacctgccttgtgagtgtgagaanatgttaaataagttcttcaganagagggaaaaataatacaggtcagaanacttggatctacataaaganaggaaganccttaanaaaagaataaatgaaggtaaaataagantttatttttgtattcttagtttagctaataaataaatagcaacattgcaattgaagattatatattatgggccaagcacagttgctcatgcctataatcccagcactttggtaggctgaggcgggtggatcacaaggtcaggagtttaagaccagactgaccaacatggtgaaaccctgtctctaccaaaaaaaattacaaaaattagccagtcatggtggcatgtgcctgtaatcccagctactcaggaggctggggccaggagtatcacttgactggga

SEQ ID NO: 40288 - DNA, 119 bp, Homo sapiens
agagaagatagggaaattagaagataaaaacatacttttagaagaaaaaagataaatttaaacctgaaaagtaggaagcagaagaaaaaagacaagctaggaaacaaaaagctaaggac

SEQ ID NO: 40289 - DNA, 227 bp, Homo sapiens
  misc_feature 104: n = A,T,C or G
ctaaggttttgttgtgttctgttgaaggtgccattttaaattttatttttattactttttttgtagatgaacttgagctctgtaacttacacctggaatgttangatcgtgcggccgcggccggccgagctgcctggcggggttggcccttgtcttttcaagtaattttcatattaaacaaaaacaaagaaaaaaaatcttataaaaaggaaaaaaaccaaccggtc

SEQ ID NO: 40290 - DNA, 245 bp, Homo sapiens
atccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttg

SEQ ID NO: 40291 - DNA, 115 bp, Homo sapiens
  misc_feature 8, 9: n = A,T,C or G
cactgtannccctttaaaaaagggtatgttgatttggtgccaacttcctttaaagccattgttcggaaaaaattagtagctaagctgatttcattctctttttgattactgttac

SEQ ID NO: 40292 - DNA, 215 bp, Homo sapiens
  misc_feature 21: n = A,T,C or G
attgaaccgatgaaatatttnactttcttgtaacaggagaaaagttatgactgatttaggtatcttccgtgcagttttggaagtatcttcttgaatacacatatgtgagcacatgggcagtaggccaaatgacatgtagtttttttccttctacagttttgaaaacctcataaatcaagagaaattgtccctcttaaaaaaaaagcaaacaacta

SEQ ID NO: 40293 - DNA, 490 bp, Homo sapiens
  misc_feature 3, 6: n = A,T,C or G
aanagnacgggtctaatagatcgctggagacacaatttaactgaaccccgcccgttgtggactgactttgatgctctgagtccctccctccttcacgccgctagcaggccctgatgtagattgtctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagcgcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggttttctgacctgtggataactacataaagagat

SEQ ID NO: 40294 - DNA, 277 bp, Homo sapiens
  misc_feature 5: n = A,T,C or G
cattnagctgcagctggttcccaggaaaatgaaagcagttccttctggttttttcctttcatatgaaagtcatagttcccagcagatggctttcatcagccctgtacatgtatctgtaaattcaaggccaaggaattattttcaacttcattagggaacaggtgaagaaaccatttgtagtgtggcactattttattaggagttgaaattaagcatagagattatagtagtatgccattctgggtcaaaatagtttttaactgtcagcaatttaaag

SEQ ID NO: 40295 - DNA, 274 bp, Homo sapiens
gagttcctgagtttgaagaaccgttggaaccttggcagtctggtttctagccttctgctatactgggtataaattttgtggcagtaaaactgaatatttccccttatatgaaaggagattgtgacctgtggtaaacaatgtgtatgaatttagggataccatttatttgatctcaaattcctggcctcaagcattctgcccacctcggcctcccgaagtgctgggattactgccatgagccactgcgcccagctcaagggatgccatttatttg

SEQ ID NO: 40296 - DNA, 440 bp, Homo sapiens
  misc_feature 2, 3, 361, 369, 371: n = A,T,C or G
anntggaaagccctcggatttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacatcatatgcatggacacagtgaccatgggcatggtcacagccacggatctgcgggtggaggcattgaatgctacatgagngggggggnantttctacattggttttggcagatacacttggcagcattggtgtgatcgtatccacagttcttatagagc

SEQ ID NO: 40297 - DNA, 183 bp, Homo sapiens
tggcccgggaatgtatatgttaattctaaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaat

SEQ ID NO: 40298 - DNA, 166 bp, Homo sapiens
agagctgtcctctagaaacactggacaccttcacccaacacccagtatcccctctgttgagatggactcaagaaccacagccattggaagagaagtggcagcatcgggttgttgaacagataccctaagaagtccaattccagccaccaggggctccactcgagga

SEQ ID NO: 40299 - DNA, 469 bp, Homo sapiens
gcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggttttgaagatgccgcatttggattggatgaattccaaattctgcttgcttgctttttaatat

SEQ ID NO: 40300 - DNA, 473 bp, Homo sapiens
atgcaggattcaaggaagaaattagaccagatgagaagtcaagctcgaagtagaaaatgtcatgatgagaaaaattattaaaaaacaggatgaacaaattgagcggtttgagaaaatcctgcagcattcaagtttgatgctgcaggtgtttgagagctagatgaagatatggacatttctggaattacagagccccctctacattgagcacaagacagtgacgaatccacattcttcagccagaaagtcacctctgagagccaaatgtctgataatagacaagagagtcagagaatgataacgacatctcaggaaaattgtgaaaataatcagcaaccttagggaagaaatataaacactggagattgccccagagctgcagtgggcagcctaggagtgccaagccatgatctacagccagcactcaaggaggagagaagcacattttcagatcattgagagtgaacatggct

SEQ ID NO: 40301 - DNA, 482 bp, Homo sapiens
caatatgtctcttttggacttcggggactaatatcaaaaaattaatgaggaccaaagttagaatttgattgtcgaaggtttgtcaaacataaaaagtttaaaacacttaatatcacaaagtaggatcacaggtcattgtaaagtcattcatttagacaaagcgataactcaaagattttttttaaggggaaaacctttattctttgagaggagacttcatttcccaaacaataagccttaataaagacaggatgaggccaattaaacttgttctccaaaattttataaacagcctataatattaaatagtttaatcatcttgaccataagatgtaatttccttaagccttttttataaccttttattaaggagtgggttaacgctccaagaaaaccttgttaatctgactcagaggcccatatgctagtcttgcatcactgccttcgacattaatggttaatttatagagaaactaaactta

SEQ ID NO: 40302 - DNA, 473 bp, Homo sapiens
  misc_feature 472: n = A,T,C or G
tgttgcagacatgggaattatatagatttgcacaggatcagcagttcctgacttcttttaacacttcagaatcaccattcccatgctttttcatcatccccagaccacctcaacccatgttttaaaatattacacttgtcaacaacctttatcaagtcataattaactaagttccctattttacaaccattagagtagttacatcattaaattgctagctaaatattgtgatcagcatgagttacccagtgagagcatcctacagagttatcatttcagctaccttcatccttttgcctgagcagcctaattgggtgcaggcatgatttccctttggctatttatttcaagggacttggacatcttcagcagagaaacatttacatgactcgagtattatttggaatacaactttgaacagaacaaacttatcaagtcattgattttggtataaaagcaaatggcaataagna

SEQ ID NO: 40303 - DNA, 278 bp, Homo sapiens
gttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaattt

SEQ ID NO: 40304 - DNA, 208 bp, Homo sapiens
aattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtgc

SEQ ID NO: 40305 - DNA, 472 bp, Homo sapiens
  misc_feature 4: n = A,T,C or G
atcncaaataaacacattgaagagggtaggaagaactagttttactttatctgtattacccctccctcaaagcagcactgctcagagccaagagagactctctcacctgtaattccttctaagggggaaagcaagagcatagtaagtaagcacccagctcccccagccatccacaacactgcccaagagccccacttctttctcacctcacccagattgctgagataatcagcatggctgagagattgggagaggctgagagcaggaaagagaagctgctggccctctgaagtgttctacagactccatcaggaagcccatccacgagctgcttgagacacctcatctactgttcccaaactctacaccccccacccccagactgagtccctaaatgtgcccccatggacagtgaatgcaagcgtattatgtagacagccagctcaactctgtgggattggggaaaaaaggt

SEQ ID NO: 40306 - DNA, 296 bp, Homo sapiens
  misc_feature 14: n = A,T,C or G
cagggaattcggcnttatggccggacacagaggttcatgcctgtaatcttagcactttgggaggctgaggcatgtggattacctgaggtcaggagttcaagaccagcctggccatcatgatgaaaccctgtctctactaaaacataaaaatttgccaggcatgatggcaggtgcctataatcccagctactcaggaagctgagatgtgagaatcacttgaatctgggagatggtggttgcagtgagccgagatcgtaccactccactccagcctgggcagctgagtgagacgtccc

SEQ ID NO: 40307 - DNA, 423 bp, Homo sapiens
  misc_feature 410: n = A,T,C or G
gcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaagggatttggttataagggttcctgctttcacagaattattccagggtttatgttgtcaggggtggtgacttcacacgccataatggcactggtggcaagtccatctatggggagaaattttggaagatgagaacttcatcctaaagcatacgggtcctggcatcttgtccatggcaaatgctggacccaacacaaatggttcccagtttttcatctgcactgccaagactgagtggttnggatggcaagatg

SEQ ID NO: 40308 - DNA, 470 bp, Homo sapiens
cacacaaggaagcactggggtggagcaagaagctgagagaggggtaagtataggtgaggtggcataagcatgctgaggactgtttcgtttggatgaatttcagtgggctctcgagcaaaggggctttccctacttgtctggcacctagccctggggtgattagggcaggtggataatggccaggcgtgtaagagcccaataaaggagatggttggggtgtgagctctggattggttgatttgtatttggaaagcacacttgggggcaaatgttttaatattcctaagagctgactagttctggaaggggcagtccctccagggccaggcaagctccaatcaaagcatcagcgtagagggaattggaagacatggctaaaacacgaaacctccacagcctggcctcactgaatatctagtctcatctccctctcctctcggaaatggactctgggcctgaaggagttccag

SEQ ID NO: 40309 - DNA, 413 bp, Homo sapiens
gtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaaggaggacagttttaatgattgtacttgcatgaacacaatcatatgatggtaaagcagaaacttaagaaaaaattgtttatgtgttatattcaattagcttaaataagttgctttgttatatttttat

SEQ ID NO: 40310 - DNA, 223 bp, Homo sapiens
gttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattaca

SEQ ID NO: 40311 - DNA, 378 bp, Homo sapiens
atatcagctctgcaagatacatagatatccccattttatggtgacggagactgaggcttagagaagttatgcaacttacctaagttacacaccttccaagcagcagagccagcattcgaacttagacccatctgactccaaagccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatgaacaaac

SEQ ID NO: 40312 - DNA, 165 bp, Homo sapiens
atacttctacataataaagtccccgtagagcaaacccatggctgacatactgaatggagaaaagaggaaagcctttcctttaagaagtggaataagacaaaggatggccactttgaccattcctattccgcatagtactagaagttctaaccaaagcagtcagac

SEQ ID NO: 40313 - DNA, 122 bp, Homo sapiens
ctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 40314 - DNA, 174 bp, Homo sapiens
caagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctatt

SEQ ID NO: 40315 - DNA, 145 bp, Homo sapiens
acgataaagtttgcacagtcttacttctgtagaacactggccataggaaatgctgtttttttgtattggactttaccttgatatatgtatatggatgtatgcataaaatcataggacatatctgaataaagcaattagcaaacca

SEQ ID NO: 40316 - DNA, 114 bp, Homo sapiens
agagcaggaaacgtagggggcggccacaccaggccttttcagagccatggaaatgtgagggaaaggctgtggagggagcttctttcccctgccccgcacacaacctagagatgc

SEQ ID NO: 40317 - DNA, 235 bp, Homo sapiens
ctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 40318 - DNA, 384 bp, Homo sapiens
tacaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaattactaatcagtttaataaaaacattttgtctattccc

SEQ ID NO: 40319 - DNA, 254 bp, Homo sapiens
agtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctccc

SEQ ID NO: 40320 - DNA, 260 bp, Homo sapiens
atagttaaaaacaaagtagaaaatatgtgatctattacaaatactggcaattagtttttaatttggatagttcataaattttcagatgaagattttacacaacatagacttgtttatatagctttacatatttgttttctaatgctattgtgaactgttgttaatttgtatactcatttctcttcattaatttatgggaggataagattgaaaataggtaacattttaaagtagctatcataaaacataaaatttttttc

SEQ ID NO: 40321 - DNA, 299 bp, Homo sapiens
  misc_feature 7: n = A,T,C or G
ggcagtncagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttatttttttttctctctctctctcttaagaaaggaaaatatcccaaggactaatctgatcgggtcttccttcatcaggaacgaatgcaggaatttgggaactgagctgtgcaagtgctgaagaaggagatttgttttggaggaaac

SEQ ID NO: 40322 - DNA, 380 bp, Homo sapiens
aggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgttggttgatgattaatttgcgagactaactttgagagtgtaacagttttgaagaaaacattgaatgttttgcaaatgaaggggcttcacggaatgttacaatgttactaat

SEQ ID NO: 40323 - DNA, 296 bp, Homo sapiens
gttgagggaaaagaagaaggagaaaggttatcagtccttggatgttgggggcgtgggggtggtcagagtttaggaaggagtacagtagaagaaaagtaagatgggaaggcattggcctactcacctgctttccagtttgggctagaagcagtctcaggtatgagaaaagaacatgaaagggctacagaaaagaactgagaaggaacagtgtgcaggtgagaattcagttttgactctccacgtcagcacgagtttggccaatgatgaaatggcgtaatgagtgaaaatcccttact

SEQ ID NO: 40324 - DNA, 114 bp, Homo sapiens
tgaaaactgaagtttggaacagtcattgctgactttctgaccaattaataatggagaacttgaatcacttaaaagaagcccaacccatagatgtcaggcttaacacaaaaccag

SEQ ID NO: 40325 - DNA, 472 bp, Homo sapiens
  misc_feature 8, 412: n = A,T,C or G
atcccttnaatttacctcttctcctcagaggtatcccattttatctcagcttcccagtttgacatcataaaataatctttggttccaccaggtttctcatttctcacatccattcagctactaagtccttttgattattctttttggagtttttcatattcctctaatcttctccattgctctagctttgcctcagagctggacaactgaaagagccttttatctgataatctcttatgatcggagagttagtatcaatgggtttacggctagtaaaatgagataactgggtatctcatttgaaaaatggggccccagaggcacactagatatctctcattgatatcttcccaagttaaaccaggataaactggatatcccaattctaattttcctgctctttatatgaagnaaggatgtctgcctttcctccagtatattttgttcactgtaactgagttcatttaattta

SEQ ID NO: 40326 - DNA, 361 bp, Homo sapiens
  misc_feature 2, 3, 42, 210, 213, 256: n = A,T,C or G
anntggtcggggcgggcagtggtgccccttcctgcagaagantcctgcagcagtagcgctggcgcccatctgcaggagctggcgggctggccttctggacccctggcttctccccactgtaacgcctgttacacacaaactgttgtgggttcctgccaggcttgaagaaaatgatctgaattttttcctccttttggtttatttttgggnggnttattttagagttttcttttctcctttttggggggtattcaanagtgggctgggcccctgggcgagacacagctacctctgttggcgtctttttaataccaggaacccagcggctctagccactgagcggctaaatgaaataaagtgg

SEQ ID NO: 40327 - DNA, 232 bp, Homo sapiens
cagaacaataaatgtctatcctaatttagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatactgtattcctgcctaaataaatcatctattaatca

SEQ ID NO: 40328 - DNA, 425 bp, Homo sapiens
  misc_feature 258, 348: n = A,T,C or G
atatgaaagccttagtttcttacaaattcctatgaccacatcaatttaagtactgcatgtgaaagccacaatacaagcgactaacatatcaaataggagaatggtccaaccagaatggcttcactggccactggcagcctttcagcagatcagtattagttcatttatttgtattcacctttaataatgatatgctatgaaaaaccttagcataccatcagtcattctaaagggaagactgcttttgcatggtgtctnggctgtgtaaactactgataaaagaacacagtattcagccatgcttttcagaccagcaaaacaatttaatagaattgatattgggggganggatcttaccatcatcaacagcatttttgacagccctcaagccatcccttactgcatctttgatctaagtgtgggct

SEQ ID NO: 40329 - DNA, 142 bp, Homo sapiens
cttgccttggttgtctggcaaggactttgtacctttgggagtttttatgagaaacttaaatgttattatctgggcttatatctggcctctgctttctcctttaattgtaaagtaaaagctataaagcagtatttttcttgac

SEQ ID NO: 40330 - DNA, 434 bp, Homo sapiens
  misc_feature 9, 27, 41, 55, 59, 60, 70, 91, 92, 104, 133, 145, 425, 434: n = A,T,C or G
tctgaaacntgcccctaccccttttanaactgaaaagtganggtacccgccaaangaanntctgcagcantcctcagactcatctcagganncacttaagcacntctgctccaagggtgggttttcttccctntaccttgcaacnggactccttgaggcacctttttagaattagtgagccgctaggatttttatactatgctttgacataaaagaaagttgcttgtcaatatgtgtttttttagtttaccagcatatcagatctcacaaacaaattttaggctcggtttggatgtttctagtaaaaacaagaaaatccaggcatcactaaaagaatcagaaatacgttgtggctttgaaaggtgcaaactaaataatatagctagcagtaacggtcaccaactcctgcttttctttggttcagngatagaggn

SEQ ID NO: 40331 - DNA, 489 bp, Homo sapiens
  misc_feature 17, 18: n = A,T,C or G
gggttcacaaatctttnntgaattattaaacctgtccctcctcctgggttgccaacttagtctctcaggctttgaagttctgtatgatctctgtctcctaaattctatcagttcccaaattgtatagactcccaaacaaataacagctttcaaatacaactttttctatattcccactactagttcactggtttttcattgcttccctcttataccaaagctaatcgttcctgtttcctccattttcaatctctctgttttcccatctctgctaaatactgctgacagataaaatattccagaagcatagaacttacaacatcgcttccttagacggacatttttaaacctcttccatatctaaagaataaactacaaccttctttgcattataggtactctgaaatgggagtccttaatcccttttctggtaaaggacctacagattgtctattattctttccatttctctgcaattgtatataattc

SEQ ID NO: 40332 - DNA, 384 bp, Homo sapiens
  misc_feature 4: n = A,T,C or G
gatngaagtaatttgtgcaaaatttggctttatgcctttattgtccggtatagtacccactaaccctatgtggctatttacatttaaattaattaaaataaaatcagggctgggcatggtagctcgcacctgtaatctcagaggtgtgaggctggcagatcacttgaggtcaggagtttgagaccagcctggccaacatggtggaaacactgtctctattaaaaatacaaaaattagccaggtgtggtggcaagtgcctataattccagctactcgggaggctgaggcaggagaatcgcttgaacctgggagtaaaaaggttgcagtgagccgagatcataccactgcactccagcctgggcgatagagcaagactctgtccca

SEQ ID NO: 40333 - DNA, 476 bp, Homo sapiens
  misc_feature 4, 35, 36: n = A,T,C or G
tctngccggggccttttttttccggcgttcaaganntcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatgggtgatggccacagtcaagaaaggcaaaccagagctcagaaaaaaggtacatccagcagtggtcattcgacaacgaaagtcataccgtagaaaagatggccgtgtttctttatttttgaagataatgccaggagtcatagtgaacaataaaggcgagatgaaaggttctgccattacaggaccagtagcaaaggagtgtgcagacttgtggccccggattgcatccaatgctggcagcattgcatgattctccagtatatttg

SEQ ID NO: 40334 - DNA, 169 bp, Homo sapiens
  misc_feature 2, 81, 117, 120: n = A,T,C or G
tnttggtgggtattgtcttgacagtggatcacaaacttggttcaatgggtagccctcaccatgaaaatcacagcttcagantcactgtcatctcagcaaaacttaaggaaaataagnganttgggtttggaccaagtccttacgtagaggtcacagtagatggacagcc

SEQ ID NO: 40335 - DNA, 442 bp, Homo sapiens
  misc_feature 27, 35, 36, 37, 38, 39, 41, 58, 61, 74, 84, 90, 93, 106: n = A,T,C or G
ccccggggacctcggcccctccggccnggggaacnnnnngncctctggctgcagttcnganccctgtcttaccnggggacctcngagacngantcagggcaacagntagggggatttgtctagtactttaagtaagactcagtctagggtgatagcagaagacctgaagacaatttgatagattttagtgatatttaaatagtgaaattaactgaaatttgtaatatattcaatataggggagttgaaagacaaggaagagtcaaggatgatacttaagatttttggcttgaggaattgagtagatggggtaccattcaataacattggacactgaaagaggttagatgtgtggagatggagaagttaaagggtcttcaagatatcaaattggggcaggcacagtggctcatgcctgtaatcccagcactttgggaagctga

SEQ ID NO: 40336 - DNA, 149 bp, Homo sapiens
  misc_feature 16, 19, 75, 89, 90, 110: n = A,T,C or G
tgtcttccagacgccnacntccgcacaaattttccactttaaccaggaaatactttctcctctaaatgcctgaantcactgttggagannctcttacttgtaatctctanttggagattacaatgattaaatcaataaataactgaaac

SEQ ID NO: 40337 - DNA, 335 bp, Homo sapiens
ggccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttacgagctaccgatggggaaggaagaagatcagcactgtggtgagctccaaggaagtggaataagttttcagatggcttattcaaacctccttagagctaacatggatgggctgaagaagagagacaaaaagaacaaaactaagaagaccaaagca

SEQ ID NO: 40338 - DNA, 363 bp, Homo sapiens
  misc_feature 7, 305: n = A,T,C or G
ctaagtnacctgtgttcacacttccactggcaaaaattcagtcacaggaatgtacttagctgcagaggaggctaggatatgccctccaaaaactcaggggggatgtcctacttgtaaaaggaagaaatgaaaaatggacactgagaggaaatcagcagtctcagaggtaatatacttacacagttttttaaaaaacataaaatgatgcagaatgaagtttccactctattcaccatctatccagtcctcatgcctcccaacaagaggtaaatactttattaattgtgtcatggtatctttccagnagtttttctaagcaatttgcaacagatataaatatgtatcccttatttcctaccttac

SEQ ID NO: 40339 - DNA, 461 bp, Homo sapiens
  misc_feature 4, 16, 36, 58, 59, 95, 434: n = A,T,C or G
cacnactctttagaanattcctctgcctgaaggctnttgccacctgtcaaaatcttcnntacttctttgcctctttcctgagcctcttgcttgantgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatgggattccacccctgccttcctaggtgaccttggacaaattctcgaacccattcaccaaccacacaagtttgttggtgagtataaatgggataatgaatatttaaaatgcccntttggaaaataaacattaaaaggttac

SEQ ID NO: 40340 - DNA, 471 bp, Homo sapiens
  misc_feature 21, 321, 323, 325: n = A,T,C or G
ataaaagctaatctctactanattggtcttgcaacagttttaaagcctctgcataattgataataaaaatgcctgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgngngnggagattactctagcaactattacagtataacacagatgatcttctccacacaccccatcacccagataatttacagttctgttaacagtggaggttggataaaagtattactgataaaaaaattattctaaagggaaaaaaacag

SEQ ID NO: 40341 - DNA, 500 bp, Homo sapiens
  misc_feature 2, 6, 33, 46, 428: n = A,T,C or G
tntttngccgggggaacccacgcctgcttgagnctctggacctgcntcctaccaccaactcgtccaactgacaagccccttgcgccctgcctctccaggatgtctacaaaattggtggtatttggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgttgtctgtcaaaggatgttccgtcgtggcaacgttgctggtgacagcaaaaatgacccaccgatggaagcagctggcttcactgctcaggtgattatcctgaaccatccaggccaaataagcgccggctatgcccctgntttgggattgccacacggctcacattgcatgcaagtttgctgagctgaaggaaaaagattgattcgccgttc

SEQ ID NO: 40342 - DNA, 442 bp, Homo sapiens
  misc_feature 19, 21, 25, 30, 427: n = A,T,C or G
tatggccgggcctcttganangaangagtnagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggggtttatgtgaacattcctatcaatccaaattccctctggagtttcatgttatgcctgttgcaggcaaatgtaaagtctagaaaataatgcaaatgtcacggctactctatatacttttgcttggttcatttttttttcccttttagttaagcatgactttagatgggggaagcctgtgtatcgngggagaaacaagaga

SEQ ID NO: 40343 - DNA, 303 bp, Homo sapiens
  misc_feature 4, 8, 26, 28, 39, 54, 56, 110: n = A,T,C or G
gganttancctgcacccctagacccnancggaccctacnagactctttctagancnctttcaattcctggctacagaaataaacatttcttttcctcagcacttggctcnttctcaaggataggcaatatattaggccacaaatcaagtgtttaaaaattcaaaatatattgaaataatattgcatatcttctctgaccacaatggaataaaactagaaataaataacaagaggaactttggaaactatacaaacacctggaatatgctcctcaatgaccagtgagtcaatgaagaaattagc

SEQ ID NO: 40344 - DNA, 155 bp, Homo sapiens
  misc_feature 68: n = A,T,C or G
agtaagaaaaacattattgaggaaaattaatatcacagcataaccccaccctttacattttgtgcagngattattttttaaagtcttctttcatgtaagtagcaaacagggctttactatcttttcatctcattaattcaattaaaaccattacc

SEQ ID NO: 40345 - DNA, 113 bp, Homo sapiens
  misc_feature 3, 13, 31, 35, 53, 70, 73: n = A,T,C or G
gcnagctgggaangtacacgcctgtgtaatnaganaccttctcgacaagtacnagctgatgtttctcacngtngccttaccacttctctgagccactctttgctgttgatttg

SEQ ID NO: 40346 - DNA, 437 bp, Homo sapiens
  misc_feature 4, 332, 344, 357, 375, 423: n = A,T,C or G
gagnggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtgggtatgcanatcttcgtgaanaccctgaccggcnagaccatcaccctggaantggagcccagtgacaccatcgaaaatgtgaaggccaagatccaggatnaagaaggcatccct

SEQ ID NO: 40347 - DNA, 442 bp, Homo sapiens
gctttccacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatggaaagattcaccaaataagctatgtacttttggttacctatgtacctgttaccactttcaaaaatctacagacagtcaatgtgggatgagaactaatcgctgatcgtcagatcaaataaagttataaaattcc

SEQ ID NO: 40348 - DNA, 342 bp, Homo sapiens
  misc_feature 11, 20: n = A,T,C or G
tggcccggganaggtagaantgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgttttttcggacagtttatttgttggagaagtgtgaccaaaagttacatgtttgcacctttctagttg

SEQ ID NO: 40349 - DNA, 140 bp, Homo sapiens
atagctgatcagttttttccctggaagcatttgtttctactttgatatgactgtttttcggacagtttatttgttgagagtgtgaccaaaagttacatgtttgcacctttctagttgaaaataaagtgtatattttttca

SEQ ID NO: 40350 - DNA, 271 bp, Homo sapiens
  misc_feature 23, 239: n = A,T,C or G
tcttaacgtgaaccgtctgttcnttgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtactntcgattagtaaaagaaaaaaattttgaatgtt

SEQ ID NO: 40351 - DNA, 386 bp, Homo sapiens
cagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgtaaaaattggtctaggcttgttacaacaaaattagtttgtatccttgggttattaaacagtatct

SEQ ID NO: 40352 - DNA, 416 bp, Homo sapiens
  misc_feature 5, 8: n = A,T,C or G
aaganttnacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttttaagtgcttgtggctcactgaagcttaagtgaaggatttccttgcaatgagtagaatttcccttctctcccttgtcacaggtttaaaaacctcacagcttgtataatgtaaccatttggggtccgcttttaacttggactagtgtaactccttcatgcaataaactgaaaagaac

SEQ ID NO: 40353 - DNA, 436 bp, Homo sapiens
  misc_feature 417, 418: n = A,T,C or G
gctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggttgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaaatgtatggcttatgtataaacattgtatggnnaataatggctttctattg

SEQ ID NO: 40354 - DNA, 500 bp, Homo sapiens
  misc_feature 6, 7, 41, 44, 454: n = A,T,C or G
tcggcnntttttggccggggcagtaggctttaacgacagantantttgtgaatacttgctaagatattaggtgagcattgccacaatgtcacacacacagtttgcaagtaacagagagtttgggaggcagacagttgagagagaggtagcaaaatgttaatgactggtaattggtgagtgcaggtaaaggatatatgagtgttcattatactattcttagcaacttttctgtacgtttaaaaacatttttttttaagttgagggcatcactaatcatgagagaagtgcaaatcaaaaccgcaatgagataccaactcacaccagttgaaatggctattattaaacagtcaaaaaacaacagatgctggcaatgctgcagagaaaaaggaattcttaaacactgttggtaagaatctaatttcagtttagccactgtggaaagcagtttgggganaagttctcatagactttaaaaaaagaaccactatttgaccctacac

SEQ ID NO: 40355 - DNA, 113 bp, Homo sapiens
  misc_feature 78, 106: n = A,T,C or G
atatagactctggtgttctattgctgagaagcaaaccgccctgcagcatccctcagcctgtaccggtttggctggctnggttgatttcaacatgagtgtatttttnaaaattg

SEQ ID NO: 40356 - DNA, 256 bp, Homo sapiens
gtggtcctccctgaaataacgcattcgaaatcctgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatac

SEQ ID NO: 40357 - DNA, 248 bp, Homo sapiens
  misc_feature 5: n = A,T,C or G
agacntgtacaactaatactctacccaaactggttttacaatgctgaaatgcaaatttacctcctgagaatatgaagagagggtttacacacctcaaaaatcaaatgctgtttatacctgagctatatgacagctataggactcaagttataagcaataagagccaataaattaatactggtgaaaagggacttttctgaaaatactttgaatactagactatgcaagaaacccagcaggaatgtagg

SEQ ID NO: 40358 - DNA, 323 bp, Homo sapiens
aggaaagggcaattgagaaaatgacagctgcctttcattgtattaagttgattcattcaacaaatatttgttgagcaaatactatgtataaaacagggcatgaagagtcatataaaacagaaaaatatgacttagttcgtgtcctcaaagaagttaaaatctggggaggcagaaagcagcattccaaagaactaaatgtgctcatcggcatttgagggctggatatggtggctcaagcctgtgaccccagcactttgggaggccaaaatggtaagatctcttgaccccagtagtttgagagcagcctgggcaacatagcgaga

SEQ ID NO: 40359 - DNA, 248 bp, Homo sapiens
gggtgtggggagcagtgggtcaggaagtgggagccagaggtttgactcactttgctttatttttcaggctacaatacaggtcagagacaatggcttataaaggtttagcgtggtctcaggatgtgacaggcagtccagcctgacctttctgcacactccagacaaacttcccagacaagctcctttgtgcctctacgtggagagggcgtggaaagttatcacattaaaagatgggagggatttgctct

SEQ ID NO: 40360 - DNA, 259 bp, Homo sapiens
  misc_feature 26: n = A,T,C or G
aaccgctttactaaacgcagacgaanaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtgc

SEQ ID NO: 40361 - DNA, 293 bp, Homo sapiens
  misc_feature 15, 40, 61: n = A,T,C or G
agctcttagtaagantacacatgcaagcattccccgttcnagtgagttcaccctctaaatnaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgtttttagatcaccccctcccc

SEQ ID NO: 40362 - DNA, 237 bp, Homo sapiens
  misc_feature 16, 22: n = A,T,C or G
ctactgaaaataagantctgantataaatttgttttctcaaatatttgctatgagaggttgatggattaattaaataagtcaattcctggaatttgagagagcaaataaagacctgagaaccttccagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 40363 - DNA, 229 bp, Homo sapiens
actcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcta

SEQ ID NO: 40364 - DNA, 363 bp, Homo sapiens
gtctattattctgttagttacagtcctaaccaagtaaacatgaagcacagtttgttttttctgagagtgttcttttctcattattaggaagagagggagatattttacccaattttatcttttttcaaaagattaaaaatataatttgttgaaaaatacctatgtagaacatacatcagacacagttcatactgtgttttgagagtatcttcttcctcattatcaggaagaaaaagattttttaccctgtttatcttttttaaaaagttactgtaaaaatactgtttattattcaaacagttatataatgttagacttttttttttctaattcgccaacctttcgtagtatcctctgcatttg

SEQ ID NO: 40365 - DNA, 176 bp, Homo sapiens
  misc_feature 4, 7: n = A,T,C or G
gctnttnttagaaaaagaacagaaacatgagttaaatataactatgatgtttcctaatctcagaactattattaacagttttttattcattttagattcaagggtacctgtggagttttgttacatatatttattttataatactgaggtttgggcttctgttgaaaccatcacac

SEQ ID NO: 40366 - DNA, 146 bp, Homo sapiens
  misc_feature 3, 41: n = A,T,C or G
tcncctgtggagcagccttctatctacctgactcctgagcnggctgccgtggtgtcatttctgtcattccgtgctctgtttccttttggagtttcttctccacattatctttgttcctggggaataaaaactaccattggacctag

SEQ ID NO: 40367 - DNA, 214 bp, Homo sapiens
ggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttcc

SEQ ID NO: 40368 - DNA, 364 bp, Homo sapiens
  misc_feature 271: n = A,T,C or G
ggtaaacttggctatgattttctgttgggccaactccccatgcccctgagaaacacattcttcacaaaaataattgtaataggccgggcgcggtggctcacgcctttaatcccagcactttgggaggccgaggtgggcggatcacaaggtcagaagatcgagaccatcctggctaacacagtgaaaccccgtctctactaaaaatacaaaaattagccgggcatggtggcgggcacctgtagtcccagctactcgggaggctgaggcaggnagaatggcgtgaacacgggaaggaagagcttgcagtgagccaagatcgtgccactgcactccagcctgggcaacagagcaagactccatcccg

SEQ ID NO: 40369 - DNA, 347 bp, Homo sapiens
  misc_feature 35, 324: n = A,T,C or G
caagtgaaacattcaatgctttggcttccaagaangacaatgagcaacactgtgttcaaagtcaaggattattggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtangaggggagaaagcgggacctgga

SEQ ID NO: 40370 - DNA, 391 bp, Homo sapiens
atctattggaggacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtgggttttgatcttttcaaaccattttctttttgaaaaaaggcattagttgtagtcatggacattaaatgggccatatatgcttatcaatcaaaaaagtgttccttttttggaactgcccattttctggatcttccctctcaatggtgggggggatgaaaaccttgggttg

SEQ ID NO: 40371 - DNA, 260 bp, Homo sapiens
  misc_feature 107: n = A,T,C or G
cgcaggaactgtgtgtgtcctacacaatggtgctattctgtgtcaaacacctctgtattttttaaaacatcaattgatattaagaatgaaaagattattggaaagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 40372 - DNA, 468 bp, Homo sapiens
ggcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgaggactacgagcgtctcctgaagatgcaaaaccagcgtggcggccgcgctctcttccaggacatcaagaagccagctgagatgaaat

SEQ ID NO: 40373 - DNA, 281 bp, Homo sapiens
  misc_feature 44: n = A,T,C or G
gtacaggaaaacgtggctgagaagacctcaggaaacttataatnctggtaaaaggggaagcaggcatgtcttaaatggccagagcaggaggaagagagagaagggggaggtgccacacacttttaaaccagatctcatgagaactcactatcacaagaacagcaagggggaaatctgcccccatgacctaatcacctcccaccaggccttacctccaacactggggattacaattcaacataagacttgcatggggacagaaatctaaaacatatcagagg

SEQ ID NO: 40374 - DNA, 467 bp, Homo sapiens
  misc_feature 457: n = A,T,C or G
cagaatactattagaatctgatgaagacagacttcttgttgtatttaaccgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtttagatgtcctcaaggaacttgtactttttgagtccccatgattttcttcatactctggttccctttctacaacacaaccattgtacttaccatcacagtaatataccaatgtctcttggaccttatttcccttgtcgagaaaatatcaagcnataggagggg

SEQ ID NO: 40375 - DNA, 361 bp, Homo sapiens
  misc_feature 341: n = A,T,C or G
cgacagtactggggaaattatttctgttagaatggtaggccctttagaaattttaccatgattttttgttttaaaagtatctgtacatttataagaacaaaactgattttgagaggcaccctcctctatcactagtatataattcaggaataaaaagaaggccaaattataaactatggagtttatattatctgcagtcatatcaaataatatgaccaaataaaataacttgtgaatttcctaaacataattaatcacattgattaatgacctgaattaactgcttgaatttagtcaaatttgttgaagcaagtagtcccaagctatgttttgagtttagnattctgggttttttcattat

SEQ ID NO: 40376 - DNA, 436 bp, Homo sapiens
taattttctttctgttgattgggatggggatgtaatatgctgtatcctttctcccattccctgcttatccccaaatggtgcatatttttatttctttagggaactcaagtagaaactagactcccagattcttaataggatcaggaaatgactgataactttttccagcttttcccaaattgatatgcatatctcttctgtgatagtgtcctcccaaggcacagagggcccaaggtcacacgcctgccactggcattggaaacctctgtgggtaccacttgtcacagtcatgaggctgcaggactactctgactctcagtggaccccttctctatagcaaatagacagtgatggcattgggtctggccaatatatgaatcttaagattcttacgagttaattacctgttaaaagaaagctaggagggtgataaaga

SEQ ID NO: 40377 - DNA, 470 bp, Homo sapiens
  misc_feature 22, 24: n = A,T,C or G
gagccccccggaagaaaccggnanaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaatacaaggaagctgagccttcacaaggtcgaacaacacatttgatgccatgcaactgagaaagtggttcaagctgggatttgaacaaatgtaagtcagactctgcagcctat

SEQ ID NO: 40378 - DNA, 328 bp, Homo sapiens
  misc_feature 50: n = A,T,C or G
ctatgacaatgactagcactcaactttggtcattctgctgtgttcattangtgccaatgtgaagtctggattttaattggcatgttattgggtatcaagaaaattaatgcacaaaaccacttattatcatttgttatgaaatcccagttatctttacaaagtgtttaaagtttgaacatagaaaataatctctctgcttaattgttatctcagaagactacattagtggagatgtaagaattattaaatattccatttccgctttggctacaattatgaagaagttggaaggtacttcttttagaccaccagtaaataatcctccttc

SEQ ID NO: 40379 - DNA, 221 bp, Homo sapiens
gagaatggtatatttgaagtgttactttcaagctgatatgccttctgaagaacttgtgtgagatcaccaagaatagttaatgtttatgatagagaaaacaccaccgggcgcggtggctcacgcctacaatcccagcactttgggaggccgaggtgggcggatctcttgaggtcaggagttcaagaccagcctggccaacatggtgaaaccctgtctctact

SEQ ID NO: 40380 - DNA, 402 bp, Homo sapiens
  misc_feature 9, 190, 288, 300, 327, 330: n = A,T,C or G
tctaagagntaccttatttttctagataagcaaatatatatattagaaaagttttttgtatcaactaattattgctagatagattaagtaaataaactattgcacagtggttataagaagtatccattgagaacagaggctctgtaactatccgggtctggttagtgtcttttttgggttatcattaggngtcagtttttcaacacctatatttttctttggaaaaagaaacatcccgtcagaaaaggggccctatgacatgaagtctctataactatcctatttggngggttttttcangctgtcattagatgtagacttttctgnggnatttacccttaacacctgtactttctcttttttctttgaaaataattgtcttttttgccacttattgaaatg

SEQ ID NO: 40381 - DNA, 297 bp, Homo sapiens
ctgcatatgttgagccaccttgcatcccaggaataatgtgtagttaatcatggtggattagctttttgatgtggtactggatttggtttactggtattttgttgaggatttccaaatccctgttcatcatgaatattggcctgaagtttcttttcttattgtgtctctgccaggtttctgtataaaaatgatactggcctcataaaatgaggttaagggaggagtctttcctcctaaatcttttgtaatagtttcagtaaggatttggtagtagcctctttgttatacatctggtag

SEQ ID NO: 40382 - DNA, 408 bp, Homo sapiens
  misc_feature 176, 407: n = A,T,C or G
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctngggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggatcgagacatgtaagcagcatatgggang

SEQ ID NO: 40383 - DNA, 315 bp, Homo sapiens
ggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcact

SEQ ID NO: 40384 - DNA, 378 bp, Homo sapiens
  misc_feature 21: n = A,T,C or G
gtgtgttcaacgactgccgtnacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtg

SEQ ID NO: 40385 - DNA, 294 bp, Homo sapiens
gcaagcaacagcgacgcgagtatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaat

SEQ ID NO: 40386 - DNA, 382 bp, Homo sapiens
  misc_feature 44, 53: n = A,T,C or G
agcaatatataacacagtatatgcttttttatatattcaatgtnagcccaagnctgaatttacattgtgactaaaggcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtaca

SEQ ID NO: 40387 - DNA, 320 bp, Homo sapiens
  misc_feature 6: n = A,T,C or G
gtctgngcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaac

SEQ ID NO: 40388 - DNA, 295 bp, Homo sapiens
aataccaagtgttgttggaaatttattactaaaaataatgaaatctgatctcagactttcagaaaaaacataattggtcttgtgattcaggtaaataattttaacttctcaaaggattcagtagttggggtgaaatattttcagtgaatttctacttgaaacaagagtaaaggtagacctggcacaatggctcatgtctgtaatcctagtaacttgggaggcccagcgggggacgatcatttgaggctaggcgtttgagaccagcttggggaacaaagtgagaccctgtctctac

SEQ ID NO: 40389 - DNA, 194 bp, Homo sapiens
  misc_feature 7, 8, 29, 43, 91, 114, 139: n = A,T,C or G
aaccctnntttgggaacaagagagttttnttcttttttagatnaaaccattctgtaaaatctttgttgtttaattaaatgtgccgttattnacccctgatgttatttatgactntgtgccgattcctgctcgggctgtntgctgttggctggtaataatatatttgatttaaatgctgtttgactgtgctatta

SEQ ID NO: 40390 - DNA, 174 bp, Homo sapiens
  misc_feature 31: n = A,T,C or G
caagcactgtatgtgttcatgaagtcttaantagagaaacacctgtttccccattgcttctctctccttccccacacccctgcacctgccccaaccccaggcactagagggaacagtaacagagggagattggcactgcattgccagtacttcacccatctatacccctccacc

SEQ ID NO: 40391 - DNA, 318 bp, Homo sapiens
  misc_feature 16: n = A,T,C or G
gaagcatcaacatggnaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatg

SEQ ID NO: 40392 - DNA, 332 bp, Homo sapiens
  misc_feature 1: n = A,T,C or G
nattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccca

SEQ ID NO: 40393 - DNA, 343 bp, Homo sapiens
agaagcgagtatgacgaagggaacgtcatcgcttggaaagcgtcgcaataagacgcacacgttgtgccgccgctgtggctctaaggcctaccaccttcagaagtcgacccgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttg

SEQ ID NO: 40394 - DNA, 116 bp, Homo sapiens
  misc_feature 32: n = A,T,C or G
ctctactattactggtgcatagctggcctaantagcttgtatttataaatctgacagcctacttatatgctgccttcaaagaggtacaactattgcaagatagcgccattataggc

SEQ ID NO: 40395 - DNA, 233 bp, Homo sapiens
agagaggaatccttgtatgtttcccagggtgctctccaacccctggcctcaagtgattctctagcctcggcctcccaaagtgttgggattacaaacatgagccactgcacccggccctaaaatggaattttatgtaactcttacacacaggctgctatgtagctgataaggataaatgttttcagtgtagtgcttgattatttgcttttttcttttcttttcttttctttttt

SEQ ID NO: 40396 - DNA, 112 bp, Homo sapiens
  misc_feature 17, 112: n = A,T,C or G
agtgaaacttttctagnaattatttttcactctaagtcatgtatgtttctctttgattatttgcatgttatgtttaataagctactagcaaaataaaacatagcaaatggcn

SEQ ID NO: 40397 - DNA, 443 bp, Homo sapiens
cacttaccctagttattataaaaaatatctaggcattgtggatataaaactgttgggtattctacaacttcaatggaaattattacaagcagattaatccctctttttgtgacacaagtacaatctaaaagttatattggaaaacatggaaatattaaaattttacacttttactagctaaaacataatcacaaagctttatcgtgttgtataaaaaaattaacaatataatggcaataggtagagatacaacaaatgaatataacactataacacttcgtattttccaaatcttaatttggatttaaggaagaaatcaataaatataaaatataagcacatatttattatatatctaaggtatacaaatctgtctacatgaagtttacagattggtaaatatcacctgctcaacatgtaattatttaataaaactttggaac

SEQ ID NO: 40398 - DNA, 345 bp, Homo sapiens
  misc_feature 1: n = A,T,C or G
nattctggaaggtttcataaaaggaagatacttgatgaatttgaagtttgagtaggaatttcattggtgagaataggtaaagacattcttaggacagggaacaaagaagaggactgaagtaaaagagtgtaaaatgggatgataaaatatccactaatcaaatctgatctgtcgggtaggaaagagagatggaaagctaaagaaggagctgaaacagtacactgtatattggttactaaagtttgatagaacagtggtttatttttcttcaaagtgtttattttaggcttagaattagaaatagctcttattagtttacttctttgttactgtgtttctctttat

SEQ ID NO: 40399 - DNA, 195 bp, Homo sapiens
gtggcaggagggtggtatgtctgcagtggtctcctgagaagctgaacgttctgtggcattaagtgtagatggggattgggcacagtggctcacgcctgtaatcccagcactttgggaggccgaggtgggtggatcatttgaggtcaggagttctagaccggaccaacatggtgaaaccctgtctctactaaaaat

SEQ ID NO: 40400 - DNA, 329 bp, Homo sapiens
  misc_feature 1: n = A,T,C or G
natgtgtaagtattacagaaatgagattgtaatatatttataattctctaattggtgttgtcagggacaaagaagctatgtgtattatacctcaaaaatagtctttttttttgttctatacattggtgtctgttatcccaaagttttgtataaactggtccgacactcatttgtatcacattacagatctatttttcatagctaatatactcagtcttttcctttaatgaagttttaaaattatgatttgttagtatttatttttgttagagaaaccctttgtcctattcaagctgttgctatggattcaaccttggaaaggtttcttg

SEQ ID NO: 40401 - DNA, 324 bp, Homo sapiens
  misc_feature 32: n = A,T,C or G
gggtggcggttgctatcgcttcgcagaacctnctcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggattttgaagtcaccgttatcttatttttcatacttttatatgtactcagacttgatcgattaatgaagtggttattttggcctt

SEQ ID NO: 40402 - DNA, 182 bp, Homo sapiens
cacagcaagtgtgctaccgtgcaattttcacttaaattcccactttcttctcattaggtcttttcatttagatctggggcctctgtgcatgcttcagtgtttctattatatttgaaatgtcataaaatagatatgtgggtgattttgtactgggcgattacataaatagtgatcttttctgg

SEQ ID NO: 40403 - DNA, 326 bp, Homo sapiens
  misc_feature 260: n = A,T,C or G
ggggggaacctctaacctaaaggaatggtataacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggngtttcttttattgaacttttaacagtctctttagtaaatacaggtagttgaataattgtttcaaga

SEQ ID NO: 40404 - DNA, 446 bp, Homo sapiens
  misc_feature 30, 442: n = A,T,C or G
gaactcggtggtggccactgcgcagaccanacttcgctcgtactcgtgcgcctcgcttcgcttttcctctgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttgggtcaagtttaaatgactgtgctgcccctttcacatcaaagaactactgacaacgaaggccgcgcctgcctttcccatctgtctatctatctggctggcagggaaggaaagaacttgcatgttggtgaaggnaaga

SEQ ID NO: 40405 - DNA, 160 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgct

SEQ ID NO: 40406 - DNA, 330 bp, Homo sapiens
gaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttatt

SEQ ID NO: 40407 - DNA, 420 bp, Homo sapiens
  misc_feature 16, 23: n = A,T,C or G
ctttttaatcctgtcngcagccngacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatact

SEQ ID NO: 40408 - DNA, 104 bp, Homo sapiens
gtaagagcagtaagcaacttattatatagaagaaatcctcagtaaaattatcaactgatttctcatcacaaaccatggaggccaaaggcagtgtgatgacattc

SEQ ID NO: 40409 - DNA, 403 bp, Homo sapiens
tacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccaccccctaccct

SEQ ID NO: 40410 - DNA, 466 bp, Homo sapiens
  misc_feature 155: n = A,T,C or G
gggaacttattttactttgctcgatttcctgttgattttaattcctctaccagtgctgctgctatcccattatgtttcaaaaattgagagattatgaaagagacttaaatacgtacagtattttaatctatgataagagtggcattttatattangagaagcaaaaggggttagtgagtaaagtatattgggacagtctggaaaaaataatgtttcttacatcaaaacaaatttcagccggaatcaaaaatataatattaagccataaaatagcacaagaaaatacagggcaaatttttatactattggagtaaagaagggctttctaaataatgccaaaaaaccagcatccatgaaaggaaagtatccaaaatttatgcatggaaaaaacaccatgaacaaagtcaaaacacaaaagatagaaaaaaaattgtaacagacgtgacagggctaaattatctaacat

SEQ ID NO: 40411 - DNA, 292 bp, Homo sapiens
  misc_feature 35: n = A,T,C or G
gacttcacagtagtaatgcagttgtcttgacttcngtctgtctgttctgttggcaggtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcat

SEQ ID NO: 40412 - DNA, 421 bp, Homo sapiens
aatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagcaatta

SEQ ID NO: 40413 - DNA, 468 bp, Homo sapiens
  misc_feature 21: n = A,T,C or G
gcagtgtgaaatcttcagagnaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgagggaggttgttttagctctgctaaaaactccagcgcaatttgatgctgatgaacttcgtgctgccatgaagggcctt

SEQ ID NO: 40414 - DNA, 405 bp, Homo sapiens
agataatgacacaatcaaatataaattgcaagtatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgaga

SEQ ID NO: 40415 - DNA, 397 bp, Homo sapiens
gggtggcctttattcggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgcccactgtgctttcaaacatagataaagcatgataaagattattatttaagatatacttgtatttatac

SEQ ID NO: 40416 - DNA, 368 bp, Homo sapiens
  misc_feature 33: n = A,T,C or G
ggtctaaatgtgagtattttagaaacagctgangaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatac

SEQ ID NO: 40417 - DNA, 459 bp, Homo sapiens
  misc_feature 3: n = A,T,C or G
acnatccagaaactactactataattaaactgtgggcaaaataatgtaggatatttttgtagaccgtaaaactgaaattaaagttgttactgatcaattaatgaggtgataattaaacagaaactagccaacctgactgattgtagaccaatacctaaaatttgtttttgcaattcacatcctttgagatatatttaattacatttataacacatggatatttaatataatcttttgtgacagattgacagatcttcactatcattatgtgtaattcctcttgatgtttttgtcattattgcatatatatttgggagagaaataaaaggctgtttccaaggtgatggtgataaagagcaaacttataaaaatggttgcctccttttgtttgtataaaacaaccatctcatttccctctgggaggtcactagaggtatgatagctctgttttgaaataat

SEQ ID NO: 40418 - DNA, 461 bp, Homo sapiens
  misc_feature 31: n = A,T,C or G
ggaaccgtcatgggacttcagcatggcggtntttgcagatttggacctgcgagcgggttctgacctgaaggctctgcgcggacttgtggagacagccgctcaccttggctattcagttgttgctatcaatcatatcgttgactttaaggaaaagaaataggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattg

SEQ ID NO: 40419 - DNA, 468 bp, Homo sapiens
  misc_feature 7: n = A,T,C or G
gagctgntggtgtttacagcaagcatggagatctatggctctgctgtggcagataaactggacaatagcagaagtattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctgactgggacacaggcggaagcctaggagagccgaatcagtgtttgtgaaagaaggcaggactggccagagtgacagacatacggtgatccaggaggctcaaagagaagccaag

SEQ ID NO: 40420 - DNA, 326 bp, Homo sapiens
  misc_feature 6, 14, 29: n = A,T,C or G
gggaanaaaaaatnacttttgaaactcgnacttcagtgtatacccaataatttaaaattatgtgaaatgttttaaatttgtgaactcgtaattactgttttaatgattcagtttcttcagagtggtaattgtataaaattgctattgcagctttacattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgc

SEQ ID NO: 40421 - DNA, 377 bp, Homo sapiens
aatgagcaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccataaagacaaaccaatcaaccatgacaaaggaagttgacctgaacatgtaaccatgccctaccctgttaccttgctagctgcaaaataaacttgttgctgacctgct

SEQ ID NO: 40422 - DNA, 354 bp, Homo sapiens
  misc_feature 10: n = A,T,C or G
aacatcaggnaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatg

SEQ ID NO: 40423 - DNA, 411 bp, Homo sapiens
  misc_feature 6: n = A,T,C or G
gggaantccatccccatgatccaatcacctcctaccagatccctcccctgacacccgaggattacaattgaacatcagatttgcatgggtacacagtgccacacactgtgtcacattgtttctgtatttcttttttctacattccctttcatactgtattcaattttttaatggaaaatgttaatttctactcaaataattgttaccatttcctctcctaaattcttggatgctttgtagtttccatcactgaatattgtcagctcttttcttatgcactgtatttttttttatcatggcaaagaaattgaaattgtggttctaatagcatctctagaagaatacagtggcaggctctggaagggagaagtaggtagctgggcatgtgtaagggggagtgttactttttat

SEQ ID NO: 40424 - DNA, 423 bp, Homo sapiens
gctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatgtgtggccgagtgtaacaaccatataataaatcacctcttccgctgttttagctgaagaattac

SEQ ID NO: 40425 - DNA, 429 bp, Homo sapiens
  misc_feature 7, 32, 33, 34: n = A,T,C or G
gctttcncgcaacgggtttgccgccagaacannngtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctctggctgactgtgctgtcctgattgttgctgctggtgttggtga

SEQ ID NO: 40426 - DNA, 391 bp, Homo sapiens
acctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgc

SEQ ID NO: 40427 - DNA, 456 bp, Homo sapiens
aaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtgtgaaggcttttggtctccctgggagtgggtggaggcagccagggcttacctgtacactgacttgagaccagttgaataaaagtgcacac

SEQ ID NO: 40428 - DNA, 386 bp, Homo sapiens
  misc_feature 16: n = A,T,C or G
atggccgggatgcttnaaaaatttaaaatatttttgaagtcttagattttttctgtattaaaaaagtaatcgttattttttgtttaaaacataaattaaaacatagaaaggtgctgggattacaggcgtgagccactgcacccagccctatatgaatgtttttatatagtctgtaagttattgtttattcttcttttttgctattaaaaacgtacagtctcctctaaaaagaagtcatccatcccaaagacatcagtattcctagaagcatagttttatttttactaattcagatacctgtatgttttatattagtttgctaaattattttgtctaggcaaagcttaaggcagctacttagaaatgtgagaaaggtattttaactg

SEQ ID NO: 40429 - DNA, 240 bp, Homo sapiens
aggtagatggtgcttttttcctccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagc

SEQ ID NO: 40430 - DNA, 464 bp, Homo sapiens
  misc_feature 32: n = A,T,C or G
gaatgtcgtgtattgggagtgccaccacctcntatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacatt

SEQ ID NO: 40431 - DNA, 320 bp, Homo sapiens
ccggcgggtgacattcagccggtggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttat

SEQ ID NO: 40432 - DNA, 167 bp, Homo sapiens
  misc_feature 50: n = A,T,C or G
ggacaagctgcagctgctgcgcctgatgctgggtcagccccgctcccagnatgtaaagaacgcgacttccacaaacctggattttttatgtacaaccctgaccctgaccgtttgctatattcctttttctatgaaataatgcgaatgataataaaacagctttgact

SEQ ID NO: 40433 - DNA, 276 bp, Homo sapiens
  misc_feature 7: n = A,T,C or G
gcaatancttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagagtattttactctttaaaatcctgcctttctg

SEQ ID NO: 40434 - DNA, 356 bp, Homo sapiens
  misc_feature 4, 33: n = A,T,C or G
aacnatacgtagaatgtaaagcttgtctgatcnttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 40435 - DNA, 380 bp, Homo sapiens
  misc_feature 8, 19: n = A,T,C or G
ggattgcnaattatatttnacttaaagggtaattttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatac

SEQ ID NO: 40436 - DNA, 412 bp, Homo sapiens
  misc_feature 42: n = A,T,C or G
tatggccgggagtgtccctgttgctgctactgacccgtgtcnagcctgggacagacgtgggtgagtaagggtggggattggcacaggggtacccgctgcatctcaggctgcaggacaaacccaagacctcactttgtttccaaattctcacacatggctcctgcctccttcctttccctgaggagaggtttccagatgtccaggacaatgcatgtccccaggaagctctggtaagcccagcctggccaacatggtgaaaactcatctgtactaaaaaaacaaaaattatgtgggttggtggtgtgcgcctgtaatcccagctacttgggaggctgaggcaggagaatcacttgaacctgggaggcggaggctacaacgagccgaaattgcaccactgcactccggcctgact

SEQ ID NO: 40437 - DNA, 252 bp, Homo sapiens
  misc_feature 7, 31, 57: n = A,T,C or G
gtgctgnccatcgacgagaaaggactgaagntgctggggccatgtttttagaggccntacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 40438 - DNA, 318 bp, Homo sapiens
  misc_feature 34: n = A,T,C or G
aagaaaaccgtttagtgtatttagaatgtgtaantttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcat

SEQ ID NO: 40439 - DNA, 334 bp, Homo sapiens
  misc_feature 35: n = A,T,C or G
aagaacgcggtttgcctgaggctgtaactgagtanaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtg

SEQ ID NO: 40440 - DNA, 418 bp, Homo sapiens
  misc_feature 7, 32, 370: n = A,T,C or G
aaatagnaaaagaagaagtcacattctctctntttactggtgatgtgattctattcctcaaaaaccctaaagacttcaccagaaggcttctggaactgataaacaacttcagtaaagtctcagtataaaaagtcaatgtggccgggcacagtggctcatgcctgtaatcccagcactttgggaggctgaggcaggcggatcgactgaggtcgggagttcgagaccagcctgaccaacatggagaaactctgtctctactaaaaacacaaaattagctgggcatggtggcgcatgcctgtaatcccagctactcaggaggttgaggcaggagaatcgcttgaatccaggaagcagaggttgcagtgagcanagattgcaccattgcactccagcctgggcaacaagagcgaaactccat

SEQ ID NO: 40441 - DNA, 133 bp, Homo sapiens
  misc_feature 17: n = A,T,C or G
gatacatttgtaaatcntgggaatgtatttgatggtaattgcctgtggtggttgtatcatgatttaattttattatgagcttttggctttatatatttttctgcctttttatgcattcattaaacagtttaac

SEQ ID NO: 40442 - DNA, 323 bp, Homo sapiens
  misc_feature 33: n = A,T,C or G
atgacactgatgccgaagatgatgctcctacanaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttattttttt

SEQ ID NO: 40443 - DNA, 160 bp, Homo sapiens
  misc_feature 32: n = A,T,C or G
cttccccaaatgttattcatttagaacaaatnaggtatattttttagaatcaactttgtaagcactataaaatctttaataagttataaggtctatgatgtgtttactttaaaaattgctgttaaaagcaacacgtattaaatatgtaattatcatctgg

SEQ ID NO: 40444 - DNA, 279 bp, Homo sapiens
ggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttg

SEQ ID NO: 40445 - DNA, 245 bp, Homo sapiens
atagaacgctactcaacagcaaactgcacactttttccagcatagccagaacatttttcaagatagaccatattctgggtgggaaaataagtcaattaattctgaaggatttaaatcatacaaagagtgttcactgaccataatggaattaaattagaaaggaatctggaaaaatatcttgtaactgaacatcacacttccaaataacccaggggcacatcctgagacattaaaaacatcttaac

SEQ ID NO: 40446 - DNA, 475 bp, Homo sapiens
  misc_feature 17: n = A,T,C or G
gggtggcagctccaaancattggatgctggataaattgaccggtgtgtttgctcctcgtccatccaccggtccccacaagttgagagagtgtctccccctcatcattttcctgaggaacagacttgagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgaagaaagatctttgtgggcacaaaaggaatccctcatctggtgactcatgatgcccgcaccatccgctaccccgatcccctcatcaaggtgaatgataccattcagattgatttagagactggcaaga

SEQ ID NO: 40447 - DNA, 264 bp, Homo sapiens
ataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactg

SEQ ID NO: 40448 - DNA, 433 bp, Homo sapiens
  misc_feature 372: n = A,T,C or G
atggaaaccaatgagcatggctatgtcccaatacaactctatatggacactgaaacttgaatttcatataatatttatattgcaaaatatttttatttttttaaccacttaaaaacctttcttaacttgcaaggccttacaacaatagagggcaagccagattatcctactggtaatagtttgcccatgctttgctctggaccagagaaaactccattaggatcaagtcatcctatgaagtcaggcattccctattgacccatccccaattcccatgtgccaagtgagacttttcctctttaaatttccagagatgggcctgggtgcgatggctcacacttataattgcagcactttgggaaactgaggcanggaggattgcttgagctcagttcgagactagcctgggcaacacagtgatacctcatctcta

SEQ ID NO: 40449 - DNA, 309 bp, Homo sapiens
  misc_feature 7: n = A,T,C or G
aaggganagattttaaaagaaagcagaaggcctgcatggtggctcgcgcctgtaatccaggcactttgggaggctgaggcgggtggatcacctgaggtcaggagttcgagaccagcttggccaacctggtgaaaccccgtctctactaaaaatataaaaattagccgggcgtggtggcgggcgcctgtaatcccagttactcaggaggctgaggcaggagaatcacttgaacctaggaggtggaggttgcagtgtgccgagattgtgccattgcactctagcctgggcaacaagagtgaaactccgtct

SEQ ID NO: 40450 - DNA, 450 bp, Homo sapiens
caccctcagtgcactctatgccggcgccgtagctacctctttctgggaggtatcttgatgtcagccctgagcttgttgcttttgtcttccctggggaatgttttctttggatccatttggcttttccaggcgaacctgtatgtgggactggtggtcatgtgtggcttcgtcctttttgatactcaacccattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtact

SEQ ID NO: 40451 - DNA, 266 bp, Homo sapiens
  misc_feature 33: n = A,T,C or G
aagtaacaggcagaaaagattatatgtcatacntccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaagagcagaataaaagc

SEQ ID NO: 40452 - DNA, 454 bp, Homo sapiens
  misc_feature 58: n = A,T,C or G
gacataatagagatagaaagcacagaaggagcgtggatcggaagagaagggatacttnggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatat

SEQ ID NO: 40453 - DNA, 203 bp, Homo sapiens
agttggagaccgcctgaccacatggtgaaaccccgtctctactaaaaatacaaaaattagccaggtgtagtggcatgcacctgtagtcccagctactcaggaggctgaggcaggagtattgcttgaacctgggaggcagaggttgcagtgagccgagattgcaccactgcgctccagcctgggtgacagtgagactccatccc

SEQ ID NO: 40454 - DNA, 440 bp, Homo sapiens
  misc_feature 21: n = A,T,C or G
aacccaacctcaatctgactntcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatac

SEQ ID NO: 40455 - DNA, 349 bp, Homo sapiens
gagggcaatggcacttgcaattcaaattcgggaggagagactctgattcctcctttgtaatgcaggcacaactaatgaactcattacagctggcccatatgtgcattgcctattccttggtaaagtgggcagggagactgtagtctgccaacatgcaccctttcgaaggggctatcagtgaagaggtttcacttgtagctgtgtaagtatttctacagtgatggagggtctggggtcagtgctgagtcttcccagttcactgagattgggttgtacaattgggaccagctgtggttagtccattggttgtacttgcatgacactggagtttatgtaaatagctaagtga

SEQ ID NO: 40456 - DNA, 425 bp, Homo sapiens
gaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaactgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttct

SEQ ID NO: 40457 - DNA, 473 bp, Homo sapiens
aatggaatatgtgtatttgtcatataaaataaagaactcataagagttcaattatatacatggctgatatgctgggaaggacaggaaaataattgggaaaactaatgtcaaaacgatagctgagtttttagtaatgaaccatttccctggacttgcattgatgatagtcacaagtagagtagctataatctaaacacttcttactaaaaataagatcctagaatatccatagactgggaagttggccatagatagtgcccagatttatagaaaccaccacagaatggcttttcatctgtatctggtttttaggtgaaacaaggtgtgtttaaaaagcatatactggaaaaagagaaaaaaagaaaaaatctgtagaggaaaaatataaggaagagaagaaaattaccaaaaaagagtactgtaattagtacattttgtgtaatgagatgatctcacgttcagaaaacaagaac

SEQ ID NO: 40458 - DNA, 402 bp, Homo sapiens
  misc_feature 108, 153, 280: n = A,T,C or G
attaatagaaggcatggctcctgctgcaaccgctgtgaatgctgctgagaacctccctctatggggatggctattttatttttgagaaggaaaaaaaaaagtcatgtntatatacacataaaggcatatagctatatataaagagataagggngtttatgaaatgagaaaattattggacaattcagactttactaaagcacagttagacccaaggcctatgctgaggtctaaacctctgaaaaaagtatagtatcgagtacccgttccctcccagaggngggagtaactgctggtagtgccttctttggttgtgttgctcagtgtgtaagtgtttgtttccaggatattttctttttaaatgtctttcttatatggggttttaaaaaaaagtaataaaagc

SEQ ID NO: 40459 - DNA, 222 bp, Homo sapiens
  misc_feature 43: n = A,T,C or G
cagtgacatgtaggtaggaagcactgaaaatagtgttcccagnagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttc

SEQ ID NO: 40460 - DNA, 142 bp, Homo sapiens
attcgagggcggatcctctctggcgtggtgaccaagaatgaagatgcagaggaccattgtcatccgccgagactatctgcactacatccgcaagtacaaccgcttcgagaagcgccacaagaacatgtctgtacacctgtcc

SEQ ID NO: 40461 - DNA, 473 bp, Homo sapiens
aggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcgaggtcttcccccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagt

SEQ ID NO: 40462 - DNA, 318 bp, Homo sapiens
atcatcttaaaaaaattaagatatattaaaagactaaggccgagtgcaggggctcatgcctgtaaccctagcactttgggaggccgaggctgagggatcacttgaggtcaggagttcgagaccagcgtggtcaatgtgatgaaaccccacctctattaaaaacacaaaaattagctgggcctgtgacgggcatctgtaatcccagctacttgggaggctgaggtaggagaattgctcgaacctgggaagcagaggttgcagtgagccaagattgcgccactgcacttcagcctgggcaacagagcaagactctgtctc

SEQ ID NO: 40463 - DNA, 421 bp, Homo sapiens
  misc_feature 1, 256, 386, 407, 418: n = A,T,C or G
naattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgnaaaagaaaaattggaaatgactgctaaccagacctcgttatgaaaccaatgatgaaaaagtcacttggtgcacctctcaacaaaacaggatgctttttccgagttcttgtatatgcaaatcatttacgangcaagttttcaacagacctanaaagcaaaacnttg

SEQ ID NO: 40464 - DNA, 115 bp, Homo sapiens
  misc_feature 3: n = A,T,C or G
gantgtttgaggttttaggattgtgcactttttaagcattagagataaattttgggatgcatcatttcagaagaagatcaaaccatctctcctacagaaataaatcctcaaccca

SEQ ID NO: 40465 - DNA, 471 bp, Homo sapiens
ggtagatttttttccttcgccgtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctggctctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaat

SEQ ID NO: 40466 - DNA, 175 bp, Homo sapiens
  misc_feature 19: n = A,T,C or G
gggaagtccatggagactntaacaaatgtgaagatattccatggatcagaatataaagcaaatggaaaagtaatcagatggacagaggtaaggaaatgaaacttggcatacttgacccactttgagcacaactttttgctaggccaagagccacattctgggttgactttgtagg

SEQ ID NO: 40467 - DNA, 361 bp, Homo sapiens
gaaaggagacccaagttgaaaggcaagcttggtgtgccttgcttagggggacagtcatctgcctggattttctgactttggtaacatgaaatggagccttaagcaggtcggggtcctgttgtgaaacagaaaccaccctagatgaacgtgaaaaagaaaaagaattggtgtttgaagtgttgggagcaacatgggggaaagttactgaaaggttagttaataactgtagggaaaccactaacactgtgtcccctcgtcccatctatcagttgttaagtccatttttaggtgatactaacttcaagttcagtctcacctaactattagatatcttaaggaatacattgtattttatgtaaat

SEQ ID NO: 40468 - DNA, 482 bp, Homo sapiens
gaagagttggtctgtgtgactgatagaatacatcagaaatgatggtgtgtcacttccaagattaggttataaaagacattgggacttccatcttggtctctgtctcttttatggggctgagggtcacttgctgtgtgggaagctggcacttgtaaggagccaaggcctacgccaacagtcatgtgagtaagtaagcatggaagtgggtccaccagtcccagtcatggcttcagatgactacagccctgaccaacagtttgattgcaacctcatgagaccctgagccagaaccacccagctaagcccctcccagattcctgaccctccaaaactgtgagattttttttaatgtttattatttaggctgcctactttgggggtgattggtatgcaggaatagatcatcattacacacccccattaaatctcttcattcttcaaatcttaatatctgttttggggtttttttattatttatactg

SEQ ID NO: 40469 - DNA, 472 bp, Homo sapiens
ggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacat

SEQ ID NO: 40470 - DNA, 274 bp, Homo sapiens
  misc_feature 274: n = A,T,C or G
gaggtgaactattttgtattagcattctgatattcagcattgtcagtgtttggaagaattagaaaacctttgactggattgatttgaaagtttcaaattttactctattttctacactatgctttcctgacttgcttctttgtagaaaaacatgcttgcttttgccttgtggagagggaagctaaagaaagagatttgctggaggatgacaggatggaaggagaataagaagaaaagaaaactaggaataagtgaaatattgaaagggaaggcn

SEQ ID NO: 40471 - DNA, 177 bp, Homo sapiens
  misc_feature 30, 41: n = A,T,C or G
aaagacacctgatcctctacaactgtttantcagttttacnttttgtacagtattagtgacctaagttattttgctgtcccgtttttgtaaatcaaatgaaattataaaagaggattctgacagtaggtattttgtacatatgtatatatgttgtccaaataaaaataataaatgat

SEQ ID NO: 40472 - DNA, 426 bp, Homo sapiens
gacttttctcctgatggagcattactggctactgcctcttatgatactcgagtatatatctgggatccacataatggagacattctgatggaatttgggtgggtacagcatgaattattttagtctataattcatctccacctatcaagttatgtgaataattacaatcaccaatatatgcaacctaaaattacagtctattctaatttaaaatgttggtattatttaagcccttgactaatggaaagtcttcgatataaattctaaaagtaaatttggctctcttgatacaagtcttgctacttaacagtacccagctctctatagaagtactaattatgtttagaggtttttgttggagaaaaacagttaaaaccaaagttggacttaatcttactgtcttaaatcataaaagatttttttttt

SEQ ID NO: 40473 - DNA, 472 bp, Homo sapiens
  misc_feature 7: n = A,T,C or G
ggaagcngctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatcccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctgggaagttgtgctttt

SEQ ID NO: 40474 - DNA, 274 bp, Homo sapiens
cgcaaaaagcaccgggaaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctttccccgctctggatcctgcactctaacactcgactctgctgctcatgggaagaacagaattgctcctgcatgcaactaattcaataaaactgtcttgtgagctgatcgc

SEQ ID NO: 40475 - DNA, 134 bp, Homo sapiens
taggccgggcaaataaaaaagggtttttttttgttttgatacggagtttcgctcttgttgcccaggctggagtgcagtgagccgagatggcaccactgcactccagacgggacaacagagcaagactccatccc

SEQ ID NO: 40476 - DNA, 418 bp, Homo sapiens
  misc_feature 403, 414, 417: n = A,T,C or G
gtgtggctcctgaggagaataacattatcttgcctgataactgtctcaggggaggccatcactgttgactcaggcaacacagagtttatctccttagacaagggtggaaagtctgatggcagcatgagttggagaggatgttgcctctactgggaatgaggaagctgtttgttctggcagaaatggttcgtcgtagtttaaaaactcagtgtccccagcttcatcagaatccttttacatgtccctgttccaagttgcaggatcccattcttttccaatcaatgccctcacttcaacagacacctgcatgcacctttcattgcaggtcagccactcacatgataagagtttgtgtctgcctttccacaatttcagctctttctctacaggagataagactcanggcaatcctanaana

SEQ ID NO: 40477 - DNA, 405 bp, Homo sapiens
gtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaat

SEQ ID NO: 40478 - DNA, 427 bp, Homo sapiens
gtaaccgcaaaactctagtagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatgtggatttccacctaccgcttacctgaaatgcaggatcacctacttactgtattctacattattatatgacatagtataatgagacaatatcaaaagtagacatgtaatgacaatacatactaacattcttgtaggagtggttagagaagctgatgcctcatttctacattctgtcattagctattatcatctaacgtttcagtgtatccttacagaaataaagcagcatatgagc

SEQ ID NO: 40479 - DNA, 192 bp, Homo sapiens
aaatgggtaaattaaaaatagattgagatccagcaatcccactactagatatatacccaaagggtatgaaatgagtatgtcgaagagatatctgcactcccgtgttcattgcagtattattttgcaatatccaggatatggaatcaagctaaatgttcatcaacagaggagcagataaatataaatgaggtg

SEQ ID NO: 40480 - DNA, 480 bp, Homo sapiens
attcatcatgctagaactcctttaaaaaacagccctgttgtcaacaatggaaaccatgcccttggaattccttgagtctacctatgtgacaccttttataattgttgagattgttagatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttataaataagttcccatgatctgccattattttctttctttacctttaattttaaaaaacgtattccagattgtt

SEQ ID NO: 40481 - DNA, 275 bp, Homo sapiens
catgttttctggttcttctgtagtcttaagtatgtttgatattgttaggtgatctgcataatgtttaatcatttttttctttatataaaccagttggtataattatacctcttttcctatttaagtttgtatgtgtatatgtgattctatagagtagaaaaatgccatcagtttgaaatgatggcacaatcttagttacttggtttaaataaatagaaaattctaaagccttaaaattaagataatgctctttggcaaactcaaaataaaagcga

SEQ ID NO: 40482 - DNA, 342 bp, Homo sapiens
  misc_feature 270, 338: n = A,T,C or G
ggggagagggaggaagggagaaagtgagaagggaaatcggaaagagaaaagggaggaaacggcagagccagagagaaagaggaagagactgagtgtgaaggagagaggacacaggggatgactgagagacagagagagagagagaatgagacagagacttaaggaagagaccctgtgagtctgacaataaaagatttggacagaaacagaaagattggagagagagagagagggagagaatgagtgagagagagactggaagagacaganatcagagggagacacagaaagtgagagtggggagagaggtagtgtaaaaggaagagagagagagaganaccg

SEQ ID NO: 40483 - DNA, 469 bp, Homo sapiens
  misc_feature 393: n = A,T,C or G
cacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaatangttttcccctcttttgttaaataatatggctatgcttaaaaggttgcatactgagccaagtataattttttgtaat

SEQ ID NO: 40484 - DNA, 124 bp, Homo sapiens
ggggctaaatcgcctcctgaggtgactgttgcttattctgctggacaggtttttacataaagcaaagggcatgtgaggggtgggattccttgttactcttactgcaataaaaatcaattgtttg

SEQ ID NO: 40485 - DNA, 342 bp, Homo sapiens
agtctgaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctagctaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatat

SEQ ID NO: 40486 - DNA, 322 bp, Homo sapiens
  misc_feature 254: n = A,T,C or G
caaggaggtgagggttagtgccaccctgccgatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattngggggactgtgctagctttacccccgcaggacacacacaggagcctttgatctcattaaagagatgtg

SEQ ID NO: 40487 - DNA, 470 bp, Homo sapiens
atcccattactgggtatatatccaaaggaatataaattgttttcccataaagacacctgcacatcacaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaac

SEQ ID NO: 40488 - DNA, 408 bp, Homo sapiens
ggctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaatgtttttaac

SEQ ID NO: 40489 - DNA, 401 bp, Homo sapiens
agtttgggctgctataataaaataccacagactgggtggcttaaacaacaaacgtgtatttctcacagtctagaagctgagaattctaagagtgaggcagaagtcactgtctgatgaggacgctcatcctggtttgcagatgctgtaccctcacatagaggagaaagggatctggtctcttcctcttctcatagggcactaaaccaatgattagagcctccaccttctaaacctcatctaaacctaagtactcctccaaggcctcacccccaaataccatcacactggggattagggtttcaacatgaagttcgtggggatacaaacattcagtccacagcactacactttcaagaaagaaaaacagagctttggatgagtggggaccggagaaagagtag

SEQ ID NO: 40490 - DNA, 168 bp, Homo sapiens
  misc_feature 10, 103: n = A,T,C or G
acatttaacnagcttctattatgcctttttctaacacagactttcttcactgtctttcatttaaaaagaaattaatgctcttaagatatatattttacgtagngctgacaggacccactctttcattgaaaggtgatgaaaatcaaataaagaatctcttcacatgag

SEQ ID NO: 40491 - DNA, 473 bp, Homo sapiens
ggatctgaaagcaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtaggagaaaaaaagagccttcttcctgttataataacgatgttgcagctcagccctgaagaaaagggaaaacttgc

SEQ ID NO: 40492 - DNA, 435 bp, Homo sapiens
ctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaac

SEQ ID NO: 40493 - DNA, 353 bp, Homo sapiens
  misc_feature 347: n = A,T,C or G
gggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgngtaaat

SEQ ID NO: 40494 - DNA, 265 bp, Homo sapiens
gttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaagc

SEQ ID NO: 40495 - DNA, 106 bp, Homo sapiens
attgtttacatctgtaactttttcctcccctgttctcattacaccattctggcgaaaatgtaggcaaagtagcttccagttttagaataaataaccatttggattg

SEQ ID NO: 40496 - DNA, 466 bp, Homo sapiens
atagagtaaggcatttattgtaaacctccagggagtttctgaaaatagtatcttctcttcaaacctaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaac

SEQ ID NO: 40497 - DNA, 466 bp, Homo sapiens
ctaaatatatatgcacccaatacagtagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacagcacacctattccaaaattgaccacatactttggaagtaaagctctcctcagcaaatgtaaaagaacagagattataacaaactatctctcagaccacagtgcaatcaaactagaactcagaattaagaatctcactcaaaactgctcagctacatggaaactgaacaacctgctcctgaatgactactggatacataacgaaatg

SEQ ID NO: 40498 - DNA, 127 bp, Homo sapiens
gggtgtgatgtgacaggcctgtagtcccagctacttggatcacttgagctcaggagtttgaggctgcagtgagtcatgattgcaccactgcactccagcctggatgacagcatgagaccccatttcg

SEQ ID NO: 40499 - DNA, 237 bp, Homo sapiens
tgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagattt

SEQ ID NO: 40500 - DNA, 470 bp, Homo sapiens
atatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaagggaagatgagctaggaatcaagaaatacgcagaactgattcctgtcactggcgccaccctgccacttgcccagagctgtggtataaatttttttaataggctgaaataaaaatatgaatagcattttggcgttaagcattaaattgataaaggctatgagatacacctgctctcaaccatgttaattttttattattggtattaataaattattacttactaacatattaacaagaattgcatt

SEQ ID NO: 40501 - DNA, 464 bp, Homo sapiens
  misc_feature 5, 15, 22, 34, 43, 60, 61: n = A,T,C or G
agagnagcactcacncattccngatcttggtttntggacccanctctggaaaagaagccnnatcctagccacttggagctgcctagggaagaccccagcccggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgt

SEQ ID NO: 40502 - DNA, 470 bp, Homo sapiens
  misc_feature 444, 446: n = A,T,C or G
ctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatgggaagagaactttgccgttgaagctgctaactaccaagacactattggccgcctgcaggatgagattcagatatgaaangnggggaatgggctcgtcaccttcgt

SEQ ID NO: 40503 - DNA, 466 bp, Homo sapiens
ggatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagatacctttgtgggttttgtactataatgccaacagggcatttcagaagatggacacaaagaagaaggaggaacagttgaagcctctcaaggagaaatatggcatcaacacagatcca

SEQ ID NO: 40504 - DNA, 441 bp, Homo sapiens
ggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacac

SEQ ID NO: 40505 - DNA, 439 bp, Homo sapiens
ggggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgctgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgc

SEQ ID NO: 40506 - DNA, 299 bp, Homo sapiens
  misc_feature 13: n = A,T,C or G
atttggcaaaatnatatcaaactttctaaagtgtgtatggaaatgtaaaggacagctaatgtcttcagatggatttatattacaaaatataagacctattatagaactgtagcatttaagatagtgtagtattggtgagaggttagatagcagtaaatcaatggaacagaatagagattccagaagcagacccatgcttactggtcatcttatttatgacaaagatgacactgtggtgcagtgggaaaataattttttcccccagcaagaactgcaaggtcaattggatagccttatga

SEQ ID NO: 40507 - DNA, 155 bp, Homo sapiens
ctggataagtaactgttgaaaatttcatgaatatctttcacttattttttgtgcatatgagtgtataatatacaaaaatggtatcatattgacatactgctttaaaacctgctgcctttcagcctgggctgcatagcaagaccttgtctcactta

SEQ ID NO: 40508 - DNA, 473 bp, Homo sapiens
attgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggtta

SEQ ID NO: 40509 - DNA, 393 bp, Homo sapiens
  misc_feature 348, 375, 381, 385: n = A,T,C or G
attgattttttttgtagtatttgtaagagctcagaacttttctgacacactaatgtgcattaagtagttttcgcctccctgtaaactagtcatctgtgcaggctctttgcagccttgtgggtgggattgatcagccctgttgacctgaaggatgggctgttctgtcttttgatttgtttggaagaggagttatgaaaggaagcaagttgaattaatctcattttcactcacttatgtttgatgaaaacagacagtgacagtctccttagttatttcctttgtgcttatgttacagttacttgtgtatttatctcaattttttttttttacttattaaccctggaacanagcttccctaccaatgctacatgccanattganatanaaatatgc

SEQ ID NO: 40510 - DNA, 230 bp, Homo sapiens
caaaaattttaactttcacaaatgacttaatcttttgagaacccattcctctatctataaaaccaccaacttcatagggttgttgtgggtgaagattaaatgagaaatgcatggaaattttctctagacattgatgcattggagtgtgcttcccttcaagtgtcttcctactttcttgctgatgactctaggggtcctgtaagttgggtctcttagagtctcttaatttt

SEQ ID NO: 40511 - DNA, 351 bp, Homo sapiens
  misc_feature 221, 252: n = A,T,C or G
gcttctggaggcaaggatggccggccatgttatgggatctcaacgaaggcgaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcngaaccaccccagtgcacctccctggcctggnctgctgatggccagactctgtttgctggctacacggacaacctggtgcgagtgtggcaggtgaccattggcacacgctagaagtttatggcagagcttt

SEQ ID NO: 40512 - DNA, 237 bp, Homo sapiens
catcctgggtacattgaaatagatgaaaaacatggaaaccaaagcaggaaaaagattaagagataagcattacaaagaaggaataggaaaaagaacagaacattggatgattccattcatttgggtcgtcataacccagtcaactcttgtgttcaccttagttttttattatttcagatgacagatgagtttaagtctttctttataaagataatatatggcattttaggaaatttg

SEQ ID NO: 40513 - DNA, 106 bp, Homo sapiens
gggaggctgaggaaggagactcgcatgaacccaggaggcggaggttgtagtgagctgagatctcgccattgcactcgagcctggacgacaagactgaaactccatc

SEQ ID NO: 40514 - DNA, 443 bp, Homo sapiens
  misc_feature 408, 426, 433, 442: n = A,T,C or G
gtttgtattgttctgagtattccattttttaataggaaattatggaagtggaaattacaatgattttggaaattataacccgcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggtaagtagcctttgagttttacaattattattatcttgggagacatagctgcaggagtaaaagctttttaggatcatgttatctttccttaaaatctggttagatggataatttcataacctattttttttttactctttacttctgtggaaacaggcttcactgtntaaataggagaggatganagcccanaggtaacana

SEQ ID NO: 40515 - DNA, 397 bp, Homo sapiens
gtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaatt

SEQ ID NO: 40516 - DNA, 341 bp, Homo sapiens
  misc_feature 1, 175, 217: n = A,T,C or G
ngcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatactgngcctattgccatactagtctttgccgcctgcgaagcagcggngggcctagccctactagtctcaatctccaacacatatggcctagactacgtacataacctaaacctactccaatgctaaaactaatcggcccaacaattatattactaccactgacatgacttt

SEQ ID NO: 40517 - DNA, 435 bp, Homo sapiens
  misc_feature 174: n = A,T,C or G
gtatggagaaatgacacaggttaggagacgtcgctttgaacgcgctataggaccttctcaaacacacaccatcagaattcaatattcacctgccagactggcttatcaagacaaaggtgtccttcataatgaagttaaagtgagtatactgtggagaggacttccaaatgtggntacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaagaatattgacatgagc

SEQ ID NO: 40518 - DNA, 451 bp, Homo sapiens
  misc_feature 99, 200, 234, 346: n = A,T,C or G
ggtttttagctacttcaagggtacctgaagcgaattggcaccaaagcagcagctgtattgccgcagttctagcttcaccttcacgatgtttcccttggncaaaagcgcactaaatcgtctccaagttcgaagcattcagcaaacaatggcaaggcagagccaccagaaacgtacacctgattttcatgacaaatacggtnatgctgtattagcctagtggagccactttctgtnttgttacatggacatatgtagcaacacaagtcggaatagaatggaacctgtcccctgttggcagagttaccccaaaggaatggaggaatcagtaatcatcccagctggtgtnataatgaattgtttaaaaaacagctcataattgatgccaaattaaagcactgtgtacccattaagatatggcatttttgaagaaataaagtacatttgaaacctt

SEQ ID NO: 40519 - DNA, 175 bp, Homo sapiens
  misc_feature 2, 11, 19, 21, 30, 50, 57, 121: n = A,T,C or G
cnactcttaancggtggangnacttcggcntcgtgcgtcgatgaaagacncgcagcnagctgcgaagaattaatgtgaattgcaggacacacttgatcactcgacactttcgaacgcactntgcggccccgggttcctcccggggctacgcctgtctgagcgtcgcttacaaaag

SEQ ID NO: 40520 - DNA, 214 bp, Homo sapiens
  misc_feature 1, 11, 13, 48, 109, 214: n = A,T,C or G
ntggccgggancnttaagtagcagtggcaaatggccctgtgctagganaactgttcccctgcacaaactgaaaacttgcctcgcttagttcttttccagtgtttttacnactactgcaaaagagtcttccaaaaatactaatctcatatgcatccctaaatgtctagccacaaataattagtagtaccttttaaataatcaatttgtactcgcn

SEQ ID NO: 40521 - DNA, 268 bp, Homo sapiens
  misc_feature 37: n = A,T,C or G
gtgtaagggtccagctgatcagactggcaagaaaatncagccttcgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 40522 - DNA, 152 bp, Homo sapiens
  misc_feature 92: n = A,T,C or G
aaccccggcctgaagaaataaagtaaaattaatctggtaatttgtcacggattagttgtacaactagttagaagtttcagaataaacatgcntttcataactgtcaaatgttcttttaattctgagtccaaataaattatttggtgatgttg

SEQ ID NO: 40523 - DNA, 471 bp, Homo sapiens
  misc_feature 20: n = A,T,C or G
ctgacagcactggacaggtnatcaagacagaaagtcaacaaagaaacagtggatttaaactataccttggaacaaatggagttaaaagatatatacagaatattccatccaacaaccacagaatatacgttctgttcaacagcacatgaactttctgtaagatagaccatatgatagccaacaaaatgagcctcaataaattttaagaaaattaaaattatatcaagcactttctcagaccacagtggaataaaactggaaatcaactccaaaaggaaccttcaaaaccatgcagatacatggaataacctgctcctggatgatctttgggtcaaagatgaaatcaagatggaaatgtaaaaattcctcaaactgaatgacaatagtgacacaacctatcaacctctgggatacagcaaaggtggtgctaagagggaaagttcatagccctaaatgcctacatcaaaaagt

SEQ ID NO: 40524 - DNA, 180 bp, Homo sapiens
  misc_feature 40, 152: n = A,T,C or G
aactttaaaggtggaatatgtaaatagttagggagatccntgtaaaataatgtcttggaaactcaaaagagtccagaaaataccaaataatgagttaaaccttttctgtcttctttccaggatctagtgaaaagccatttgatgtatgcggncagagaagaagtggaggtcctcaaagag

SEQ ID NO: 40525 - DNA, 469 bp, Homo sapiens
  misc_feature 65: n = A,T,C or G
ggtaggagcctctctccctactgctgctacacaagaccctgagactgacctgcaggacgaaaccntgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggctta

SEQ ID NO: 40526 - DNA, 472 bp, Homo sapiens
  misc_feature 175, 211: n = A,T,C or G
gtttttaattagccggcatggtggtacatgcctgtagtcccagctactcgggaggctgagatgggaggataacttgagcctaggaaattgaggctgcagtgagccgtgattgtgccactacactacagccggggtgacagagtgagacactgtctcaaaaaataataaataggcnaaactttttaaaaattataatactgccagacatggnggcatgcactggtaatctcagttacttgggaggctaagataggaggatcactgtagcccaggagttcaaggccacagttagctatgactgtgcctgtgtatagccactgcactccagcctgggcaacacagagagaccctatccctgaaattaaaaataggccaggtaaggtggctcatacctacaatcccaacattttgggaggcccaggtgggaggactgcgtaaggccaggaattgaagaccagcctgggcaacatag

SEQ ID NO: 40527 - DNA, 201 bp, Homo sapiens
  misc_feature 3: n = A,T,C or G
agnaaaagactggttaatgataacaactgcctcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 40528 - DNA, 465 bp, Homo sapiens
gattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcaagagttggctttcaaagaatgtactcgacaccttgcgatccaaaatacggagctggcatatacttcacca

SEQ ID NO: 40529 - DNA, 413 bp, Homo sapiens
  misc_feature 117, 147, 161, 185, 228, 288, 299, 320, 343, 366, 371, 409,412: n = A,T,C or G
atgattaactctaagtactattaattaatagccttgcgaaatattagcaattttcccattatggactattctctctaaagcaagagagactagcattcccagacatcattctagggnctttaagctcattttgggtctgctaaagtntggggggaaatgtnacgcaaagtgatactgtgtatgtngccattttgctttattcttctgtggaagcaaaattgtggggtnttattatgtgtgtgtgcttttcctagatgtcccagttagctgtgctgagatatacctgtnctatttatggnttaagttttgattcttaggtnttttctccagctctgacattgtnttccaaagacacactaaactgcnttgcncagttcaaaatttgattacttaagggatcaatctaggnggng

SEQ ID NO: 40530 - DNA, 187 bp, Homo sapiens
  misc_feature 4: n = A,T,C or G
ggcnacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacg

SEQ ID NO: 40531 - DNA, 225 bp, Homo sapiens
  misc_feature 40, 45, 93, 173, 201: n = A,T,C or G
taagcaagatgtatctgtactgatgtctcagtgaatcagnctgtntattaagcacttatcagggcttccacacacttatttattttgccctanttaatcctgttgtttgctgccattggcatgaaatggccaactgtggctgttacagttctttcattcaattataacttgtnaaccagtgactcctaatcttttggaagntaagacaccttaccattgcttatt

SEQ ID NO: 40532 - DNA, 164 bp, Homo sapiens
  misc_feature 66: n = A,T,C or G
cctcggcactctctggccgggactcctagtctgttcctcaacaggtgaatggataaactgtggtantactttacttactcagcaaagaaacagaatgaactgttggtacacagtgcaatgtggatgagtttttaaataattattctgagtgaaagaatccaagc

SEQ ID NO: 40533 - DNA, 469 bp, Homo sapiens
  misc_feature 300: n = A,T,C or G
gaactcggtggtggccctgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcnaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggggggaaaaaatggggggg

SEQ ID NO: 40534 - DNA, 428 bp, Homo sapiens
  misc_feature 69, 78, 129, 134, 179, 212, 217, 243, 321, 324, 337: n = A,T,C or G
gacctgaagcgaattggcaccaaagcagcagctgtattgccgcagttctagcttcaccttcacgatgtntcccttggncaaaagcgcactaaatcgtctccaagttcgaagcattcagcaaacaatggnaaggnagagccaccagaaacgtacacctgattttcatgacaaatacggtnatgctgtattagctagtggagccactttctgtnttgtnacatggacatatgtagcaacacaagncggaatagaatggaacctgtcccctgttggcagagttaccccaaaggaatggaggaatcagtaatcatcccagctggngtnataatgaattgtntaaaaaacagctcataattgatgccaaattaaagcactgtgtacccattaagatatggcattattgaagaaataaagtacatttgaaaccg

SEQ ID NO: 40535 - DNA, 422 bp, Homo sapiens
  misc_feature 28, 78, 156, 326: n = A,T,C or G
ctgtattccaaatggatacaatccgacntatataaaagaaacagattcttaactattgactcttatttagcaaatgcnacagacaagaatatccaacttgatatttataaaaggtagactttttccaaaagtgtataagctcaaagaaaaaatgcnacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggncaaataataataattttaatgtcaatgattttttttgtctgactcatctgagttatatttagttttcaagtggcaataaatttatctaccttcttt

SEQ ID NO: 40536 - DNA, 470 bp, Homo sapiens
  misc_feature 143, 174, 215, 259, 309, 333, 354, 460, 463: n = A,T,C or G
gaaatgttttgtaaacatttattttttttaaagaaaagatgaaaggcaggcctatttcatcacaagaacacacacatatacacgaatagacatcaaactcaatgctttatttgtaaatttagtgtttttttatttctactgtnaaatgatgtgcaaaaccttttactgggtgcntggaaatcagccaagttttataatccttaaatcttaatgtncctcaaagcttggattaaatacatatggatgttactctcttgcnccaaattatcttgatacattcaaatttgtctggttaaaaaataggtggtngatattgaggccaagaatattgcnaaatacatgaagcttcatgcncttaaagaagtatttttagaataagaatttgcatacttacctagtgaaacttttctagaattatttttcactctaagtcatgtatgtttctctttgattatttgcntgntatggtt

SEQ ID NO: 40537 - DNA, 470 bp, Homo sapiens
  misc_feature 178, 292: n = A,T,C or G
ggggcattcctgaagctgacagcattcgggccgagatgtctcgctccgtggccttagctgtgctcgcgctactctctctttctggcctggaggccctccagcgtactccaaagattcaggtttactcacgtcatccagcagagaatggaaagtcaaatttcctgaattgctatgtgtntgggtttcatccatccgacattgaagttgacttactgaagaatggagagagaattgaaaaagtggagcattcagacttgtctttcagcaaggactggtctttctatctcttgtnctacactgaattcacccccactgaaaaagatgagtatgcctgccgtgtgagccatgtgactttgtcacagcccaagatagttaagtgggatcgagacatgtaagcagcatatggaggttttgaagatgccgcatttggattggatgaattccaaattctgcttgcttgctttttaata

SEQ ID NO: 40538 - DNA, 470 bp, Homo sapiens
  misc_feature 113, 118, 198, 247, 397: n = A,T,C or G
agcacatgagagggaggacaaggtgcggctgcacttcaagagaccacgttggacaggtgagatgtccaatatattcttacttaagatctgatttcttctccttctctccagcnagggntgcccagagatataacaattagaattcaatacgctaatacagtgtctcattagccaagccacacaatcgcctctagtggnccatatgcacgacaacccgggatcctagaaattagctcggcttcctgcntccgtccccatctgaatctttactcaactactttttgattgtgaagagccaagctcatttgagcagtaggaatttcatggggctggtgatcccaagactaattcaaaaattaataagtttcccattccttttcttatttatttttttggnagggacacatttcaccacacacgcctgcttctttcttgccagtatttcattcaaaactagtcctcaagttttg

SEQ ID NO: 40539 - DNA, 374 bp, Homo sapiens
  misc_feature 57, 141: n = A,T,C or G
gatgggatgtatttttggcttttttttgttgtcgtttaaagaaagactttaacaggngtcatgaagaacaaactggaatttcattctgaagcttgctttaatgaaatggatgtgcctaaaagctcccctcaaaaaactgcngattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacagaaaatgccgattttatttataaaagtgggtacttaataaatggagtcgttatactatgcat

SEQ ID NO: 40540 - DNA, 204 bp, Homo sapiens
  misc_feature 110, 136, 156: n = A,T,C or G
ggcgacaaacctaccgagcctggtgatagctggttgtccaagatagaatcttagttcaactttaaatttgcccacagaaccctctaaatccccttgtaaatttaactgtnagtccaaagaggaacagctctttggncactaggaaaaaaccttgtngagagagtaaaaaatttaacacccatagtaggcctaaaagcagccacc

SEQ ID NO: 40541 - DNA, 197 bp, Homo sapiens
  misc_feature 112: n = A,T,C or G
acacctgcccctgtatatccttttttcccctcccctccctcccagtggtacttctactaaattgttgtcttgttttttattttttaaataaactgacaaatgacaaaatggngagcttatgatgtttacataaaagttctataagctgtgtatacagttttttatgtaaaatattaaaagactatgatgatgacatt

SEQ ID NO: 40542 - DNA, 469 bp, Homo sapiens
  misc_feature 15, 16, 53, 452: n = A,T,C or G
tggatcgggggaagnncgggaaggaagccctgctgctcgttggactatggtcntttcttgtggtgggcattggcattgttccttgtggtggggtgttggcagggagctgcttcccctcagtgggtgctggtctttggtcttgctactcaattggatccagatatgggtgccaggaaggcccatggctgaagcctgacaccggctgctctgaagtctgcccattcatgaactggggcagctgccagttctgggcactgcggaaagtggcttgggactggggcttggtgatgcacgcggcttctgctgcccacagtttcgtgcttacagcctggctgcctccttggctggcccagaaggggtatgccagcaaagcgtacatctcctgttcccctcctggctcaccccttgccatgggactgtcacgccctgtgtggttggaagtgctattactnttgtccgtgtggtggac

SEQ ID NO: 40543 - DNA, 393 bp, Homo sapiens
tattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgttgggttgttgatcttttttttccttacagacacccataataaaatatcatattac

SEQ ID NO: 40544 - DNA, 468 bp, Homo sapiens
  misc_feature 67, 111, 182, 328, 339: n = A,T,C or G
gttgatgtcaagactaccgatggttacttgcttcgtctgttctgtgttggttttactaaaaaacgcnacaatcagatacggaagacctcttatgctcagcaccaacaggtncgccaaatccggaagaagatgatggaaatcatgacccgagaggtgcagacaaatgacttgaaagaagtggncaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatgggngaaggcagtanttctggaaaagccactggggacgagacaggtgctaaagttgaacgagctgatggatatgaaccaccagtccaagaatctgtttaaagttcagacttcaaatagtggcaaataaaaagtgctatttgaga

SEQ ID NO: 40545 - DNA, 368 bp, Homo sapiens
  misc_feature 105, 115, 133, 134, 174, 208: n = A,T,C or G
gtagttggagctcttgcagcttctgcccctatctggcagtttgaggatttagtaccttgtggtgtatttatgaagatcgtaactacagattttaggaaaagcggnccacattgtncagagagcatccacaggnnctgggatgccattaatcgactctcaaatactggcagtggnttgcagtggcttactggagcccttcacttatgcngcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgt

SEQ ID NO: 40546 - DNA, 443 bp, Homo sapiens
  misc_feature 107, 236, 247, 278, 356, 374, 430, 433: n = A,T,C or G
gaggtaggagttcgagaccacctgaccacatggtgaaaccttgtctctactaaaaattcaaaattagccgggcatggtggcgcatgcctgtaatcccaaatacttangaggctgaggcaggagaatcgcctgaaccctggaggcggaggttgcagtgagccgagattgtgccattgcactccagcctgggcaacgagcacaaaactcttggctcaaaaaaaaaatagaggaagctntgaaaagagtncaagaagcacactgcctaatttcggctgctntagaaccagagaaagaaaaaagaaggcgttcaagatcacattctaggaggaggaggactctcatcttctaaacacagncaaggagcagatcaaganagtgattacattgtcagtctaggagtcgtttgatgattcaaaagcccaagacaganaanatctcattcc

SEQ ID NO: 40547 - DNA, 213 bp, Homo sapiens
  misc_feature 72, 142, 159: n = A,T,C or G
gttttcctatatttttatgactgctgagaccccacagggaccaatatttgtattcaaattacatttcatggnttcccattgtttcacaatgagttctaataaatgggatttactataataatccaagtatgacatagccggnatgctttcatgaatgtntttatgtagattttcctcccatgaacatgagtaaataaatctgtttcctgaatg

SEQ ID NO: 40548 - DNA, 235 bp, Homo sapiens
  misc_feature 67, 90, 133, 159: n = A,T,C or G
gtagctgggattacaggtgcctgccaccacgcccagctaatttttgtatttttagtagagacagggnttcaccatgttggccaggctggncttgaactgctgacctcaggtgatccccaccacccaccttggnctcccaaagtgctgggatcataggcntgagccaccatacccagtccaaatggacaaattaatatgagataagcagcctgggcgacggagtgcgactccatct

SEQ ID NO: 40549 - DNA, 473 bp, Homo sapiens
  misc_feature 342: n = A,T,C or G
atggcaagcttctctgatgtgttccctcattctcatgtagtaaataatttgggtgttagcagctttataagaacctttataaacagccattgtgttttcctctcacatgagtctgctccaacatgctggataagcagtggtaattgataaagtcatgtatacagcctttatttccatgggtaaatttatggtcaggaaaatatctgaattagtcttgtctaagacaattgaaagaaatgtcggcatagttcctgatgatggatttttttcatgtaattcttttgcatttggcgagattctaaattgattttatgaataggacggcagattaacctttctgtnacaggctggaaaaatgatcacttggaaacatggtgccccctaatagcattctttgtagcaatcagagataatctgcttgtgtgcagtcatgttattagctcatttccttaagccggttcctaaacttgtta

SEQ ID NO: 40550 - DNA, 471 bp, Homo sapiens
  misc_feature 36, 186: n = A,T,C or G
gctcttcctcggcgctgcctacggaggtggcagccntctccttctcggcatcatggccgccctcagaccccttgtgaagcccaagatcgtcaaaaagagaaccaagaagttcatccggcaccagtcagaccgatgtgtcaaaattaagcgtaactggcggaaacccagaggcattgacaacagggntcgtagaagattcaagggccagatcttgatgcccaacattggttatggaagcaacaaaaaaataaagcacatgctgcccagtggcttccggaagttcctggtccacaacgtcaaggagcttggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatg

SEQ ID NO: 40551 - DNA, 469 bp, Homo sapiens
gtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactc

SEQ ID NO: 40552 - DNA, 234 bp, Homo sapiens
  misc_feature 227: n = A,T,C or G
aaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgcncagaggg

SEQ ID NO: 40553 - DNA, 196 bp, Homo sapiens
  misc_feature 112, 123, 124, 174: n = A,T,C or G
ggatttttaaataaattttcctcctctttcacagtaatttctgaaggagatgctgccaatcccccccgcgcctgcgaagcgcagcggctctaggtatacacttcacattgtntctttgcaggnngcacagcattttaatctgcgcccgcaatgcacaatgcgcgcatgcttgtntgccagtggaagctccatgaac

SEQ ID NO: 40554 - DNA, 446 bp, Homo sapiens
  misc_feature 158: n = A,T,C or G
gagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggnggcagacatgtctaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaaattagggtcatgtacattttcatattagaccttttttgttaaataaacttttgtaata

SEQ ID NO: 40555 - DNA, 469 bp, Homo sapiens
  misc_feature 417: n = A,T,C or G
gctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcntacaccacatgaaacatcctatcatctggggctcattcatttctctaacagc

SEQ ID NO: 40556 - DNA, 345 bp, Homo sapiens
  misc_feature 334: n = A,T,C or G
caagggaggcagacttacctccctcaaccgccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatactttttttttttttnctttaaagacc

SEQ ID NO: 40557 - DNA, 471 bp, Homo sapiens
  misc_feature 104, 158, 460, 466: n = A,T,C or G
agagacagaaagtagagtggtagttgttggggaaggaagaatagggagttgtttaattggtacagtttcagtttttgcaggatgaaaatatcgtagagattggntgcacaaggatgtaaatgcacttaacactactaagctgtacactttaaaatggnaaagatgctaatttttatgttatatatattttaccacattttttaaacagtaaaaggatggaaatgatatgctacattaacactaatcaagagaaatctgggtggtaataatatcagaataggcttcggaacaagaaatagaaccagggataaagacagactttttatgatgacaaagtgatctactcatgaagaagacataatcctaaatatttatacttctaataatagagctttgaaagtaaggtgaagtaaaactaagagaattgaaaggaggagattgacatattcacaatcatagntggggngggtt

SEQ ID NO: 40558 - DNA, 470 bp, Homo sapiens
  misc_feature 314: n = A,T,C or G
gaattgagtccgagataaacccatatatatatatctcaattgtttttgtataaggttgagaaacccttcaatgggggaagaatagtcttttaaacaagtgatgcaggacaacttccaaaaaaggaagttggaccctttacaccacatacgaaaaaataaaatgaatcagagaactaaatttaagagctcaatatataaaactattggaaaaaaatataggtgtaaattttcatggcttggattaggaaatggcttcttagatataacaacaaaagcataagcaacaacaacaaaaatagataaattggactgcntcaaaattaaaaacttgtgctgcaaaggaaaccatcaagaaagtaaacagacaacctatagaatgggagaaaatgcttaaaaattgtatatcaaaaaggagcttatctctaaaatatgtaaagaatacttacaactcaataataaaaacacaaata

SEQ ID NO: 40559 - DNA, 182 bp, Homo sapiens
agagttagaatcatacagtatgtagccttttcagcttagcttctttcacttagtaatatacatttaagttccttctacgtctttttatggcttgataactcattttattttagcattcagcaatgtttcattttctggatgcactacagtttatttaggacttcttaaaataggtcaaaaac

SEQ ID NO: 40560 - DNA, 368 bp, Homo sapiens
  misc_feature 60, 150, 180, 251, 353: n = A,T,C or G
agttttgcaaaatgttatccttgggagaaactgggcaaaatgtacaagagacacactgcnttattttttataactcgtgaatctgcagctatctcaactttttaagcaccagttgaaaaaaaaattatgagattttttttttaaaagggngtctacagctgcaagcagatcgccatcaanaacatatccgagctagagattcattaattcagtctttggcaacacagctagaattggatggctttgagcgnggaccattcagtgaaagacagattaaaaattttcacaaacttgtgagagagagacaagaaggggaagcaaaaactgccaaccaactgatgaatgactttgcngaaaaagagactctg

SEQ ID NO: 40561 - DNA, 305 bp, Homo sapiens
  misc_feature 115, 116, 164, 248: n = A,T,C or G
ggagtgggactctctctaaagaaaaaaacaagtgtatgagatccttgtgtggatgagtaaagagtgaggaaaatgcctagaagcaagttctgaggaactctaaacacttaggggnngggtaatggaggagaagctagacaaggagaacaaagaggaactgtggngggcagatcatctgaagtcgggagttcgagaccagcctgactaatatggagaaaccccgtctctactaaaaatacaaaaattanccgggcgttgtggcgcatgcttgtagtcccagctacttgggaggctgaggcaggaga

SEQ ID NO: 40562 - DNA, 262 bp, Homo sapiens
  misc_feature 55: n = A,T,C or G
ataggaactcttgttgattttaaatatttttcatttctctgtaaatacctgaccntgatctataaaagtccaaaaaatgaggttcatagattttttttgaatagtaatctttatagttcttttctttcatgctttgtgtctttccttcaggtagcaaattatggagttggaggacagtatgaaccccattttgactttgcacgggtaagtgaaaaagaaatggagaaattcactgaggcttatgcattacattgtttgtctc

SEQ ID NO: 40563 - DNA, 418 bp, Homo sapiens
  misc_feature 157: n = A,T,C or G
aggttaggagacgtcgctttgaacgtgctataggaccttctcaaacacacaccatcagaattcaatattcacctgccagactggcttatcaagacaaaggtgtccttcataatgaagttaaagtgagtatactgtggagaggacttccaaatgtggntacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaaattttgacactgaaaaacattttattaataaagaatattgacatgagc

SEQ ID NO: 40564 - DNA, 117 bp, Homo sapiens
cgggcgcggtgactcatgcctgtaatccgaacactttgggaggctgaggtgggaggatagcttgagcccaggagtttcacaccagcttgggcaagatagtaagaccctcgtctccat

SEQ ID NO: 40565 - DNA, 470 bp, Homo sapiens
  misc_feature 62, 395, 407, 410, 443, 444: n = A,T,C or G
atcacaaagacaaaaatcatctttatctcatgctcttagtagtctttgagtttactcttggncgtaaggccttaaaaagatttatcaagaaccaacataataagccagccacttatgatgaaactccctttctcctaaaagcagaattagagggagaaatatcaaataaacaaaagaatgcttctcagaccctttctaacctgctaaatctagttatttagattatagagcttgaaataaaaaagagtagaaaattttactccaaaaaaatagagagagtagatttctcagagggcccccatgcccggtaaagatttggtcagttcatcttgatgcagtttacagtttatacagccccaagactgtgcattaccaataatcatcaatattagagncattaagtgtgntgnctttatgtttcctctttgtccctattaatttgnnaacaaagcatctatatccaatagata

SEQ ID NO: 40566 - DNA, 350 bp, Homo sapiens
  misc_feature 70, 109, 113, 114, 117, 150, 234, 310, 324: n = A,T,C or G
ctgcaagacttttagattcttacaatgattactacaggaatagtggccacttaatgtcagttactccggnggaagaatttatctagttttttttcttttcttttttggnaggnnggngtgaaaaatagcaagattagagaatgagttgtntagttttttctatcacatttcatctaaaatgatttgaaggacctttgaagatttttaccaacatccttaaatcaactccaggtnggatgaacaactgatttaaaacaaactaagagaacattaactagatgtgggctttttaaaatatataggtattgcntttcctaccttgtnatttattccactttgaatactttaga

SEQ ID NO: 40567 - DNA, 473 bp, Homo sapiens
  misc_feature 388: n = A,T,C or G
agcttagagcttgttagaaatgcacagtatcaggccccatcggagacccactgagtcagaatctggatgtttacaaatgccaggtgattcatgtgcacaatggatttgaatcccatgcctccaaagcaagtgtagaaaattagtgtccatggcctatttatatgaataacattttactggaatatggtcacacctatttgttttcctattatttacagcaaagttgagtcgttgtgacagcctaaaatatttattaatatttactatatgttcatttatagaaaaagtttgcaatgcttcttaacctggatggctcattagaatcactctggagccttaatactccctctgcctgaatgtaccccacgcccattaaatcagaatgcangtaggggggtgcttgagaccccaggtgtcaacaattctaaaagtttcccaggtgatttaaatgtacagtcaaagtccagaaccag

SEQ ID NO: 40568 - DNA, 369 bp, Homo sapiens
  misc_feature 194: n = A,T,C or G
agtgtagaagtgcttcacgggaggttgttgtggaagcttggaggaataataccttttaaacgtagaagttagtactggaaaggatttcctttgggtctgggaaggtgaggaaagatagtgatacagaattgtgggagaagagcatgctaggcaaaggtaactacctctttctgaaggtggggaatgaaaaggtngcactgtgatttcagaaagctgagttcagtatttaaatgttcagtatttgctttgatgaagtgttaaatacctcctctttcttaccctctccacctagtctatattcatctttaaggagaagtttccagtgacaaggaagtttagatacgtcttttttcttttcttttctttctt

SEQ ID NO: 40569 - DNA, 473 bp, Homo sapiens
  misc_feature 140, 305, 309: n = A,T,C or G
atagtattaatgtatacacattaatgtgtaataatgacatagtgtcttatcttcatacctttacaaccataagataatatgtcagcatttcagaaaggaccatccaaaccttaacgcaaaatatgggcattgcaactggnaatatgctggtaaggaagatgtgtggagaaggagggccttcaggggcctggctaaataatgccctatatgaagctgcctgattttccaaaacaaagaaattcccatcttacccaaattcttggagttgatgttgactgtggaattctaatgtgcttggctcttanggtntgactggtttccctggtgctgctggacggactggtcccccaggaccctctgtaagtaaatcactgtaaacgtgtcttcatttactctagccaaaaggcctggcttctgataggaaactggtaagaaactcttcatgaaaacacatcactaatattcgctattac

SEQ ID NO: 40570 - DNA, 349 bp, Homo sapiens
  misc_feature 28, 68, 105, 114, 128, 138, 149, 196, 213, 279, 319, 332: n = A,T,C or G
aggacagatggatggaatacccatgtcnatgaagaatgaaatgcccatctcccaactactgatgatcntcgccccctccttgggatttgtgctcttcgcattgtntgtggcgtntctcctgagagggnaactcatggnaacctattgtncgcggaaacacacaaggctagactacattggagatagtaaaaatgtnctcaatgacgtgcagcntggaagggaagacgaagacggcctttttaccctctaacaacgcagtagcatgttagattggagggntggggggcatgacactccagtgtcaaaataagtcttagtnagatttccttgtntcataaaaaagactcac

SEQ ID NO: 40571 - DNA, 426 bp, Homo sapiens
  misc_feature 143: n = A,T,C or G
gagtggagtgaggggtaacaagtatggcgaccgagacggtggagctccataagctaaagcttgccgaactaaagcaagaatgtcttgctcgtggtttggagaccaagggaataaagcaagatcttatccacagactccaggcntatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaaagaaagctgctcgggcagctaggtttggggatttcttcagttccaac

SEQ ID NO: 40572 - DNA, 293 bp, Homo sapiens
  misc_feature 108, 158, 159, 168, 209: n = A,T,C or G
gacaatcgagtagtactcccgattgaagcccccattcgtataataattacatcacaagacgtcttgcactcatgagctgtccccacattaggcttaaaaacaaatgcnattcccggacgtctaaaccgaaccactttcaccgctacacgaccgggggnntactacggncaatgctctgaaatctgtggagcaaaccacagtttcatgcncatcgtcctagaattaattcccctaaaaatctttgaaatagggcccgtatttaccctatagcaccccctctaccccctctagag

SEQ ID NO: 40573 - DNA, 162 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgat

SEQ ID NO: 40574 - DNA, 126 bp, Homo sapiens
  misc_feature 10, 63: n = A,T,C or G
aggaaacttntaccatggatactgggggtgggggggaagaagtcccttatatacccttaaggnagggactttgattcttttttctttaaatctccttttgtatcggcattttgttttagtaggtgc

SEQ ID NO: 40575 - DNA, 248 bp, Homo sapiens
  misc_feature 119, 120, 211: n = A,T,C or G
aaggaagaactgcctggagattggttttctgtgtatgctaaagcaagatccaaaatatccatttcgcagagacatgaccagaaagtcccagcacacttgggaacagcattttaagaggnnttgaattattgtgctcattaatatattttcccttctttgatccttttcttgaggataactagagctgctttgctctacaatatttcaagcntggggagaatttagcactaggagaaaccacgtagtcc

SEQ ID NO: 40576 - DNA, 379 bp, Homo sapiens
  misc_feature 1, 26, 116, 136, 153, 191, 225: n = A,T,C or G
ntggccgggcagtatttaaaaagacnaagtattttgtccctttgagattctgcactccctgaaaagttcacttggacgctggggccaaaagctgttgattttcttaagttgacggntgtcaatatatcgaactgtncccaagttagtcaagtntgtctcaacactagcatgatataaaaagggacactgcngctgaatgaaaaaggaatcaaaatccactttgtncataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 40577 - DNA, 212 bp, Homo sapiens
  misc_feature 2, 31, 117: n = A,T,C or G
tnttggccgggattaaattgaaaccttaganaagaccgacgactgtctgtagaaatctgggactgggatcgaacaacaaggaatgacttcatgggatccctttcctttggagtttcngagctgatgaagatgccggccagtggatggtacaagttacttaaccaagaagaaggtgagtactacaacgtacccattccggaaggggactagga

SEQ ID NO: 40578 - DNA, 389 bp, Homo sapiens
  misc_feature 274: n = A,T,C or G
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtngaggcgacaaacctaccgagcctggtgatagctggttgtccaagatagaatcttagttcaactttaaatttgcccacagaaccctctaaatccccttgtaaatttaactgttagt

SEQ ID NO: 40579 - DNA, 180 bp, Homo sapiens
  misc_feature 30, 75, 96: n = A,T,C or G
ttgtacacttaacacttttgttaaaagggnagatctcatgttaaatgtctccaccccaatacaaaaaaaattgcnctattgttttatactactgtnttggaagcagaacatacttcaaaaatcttcagctcagctgggttcagtggcatacacctgtaatcccagcattttgagaggctg

SEQ ID NO: 40580 - DNA, 320 bp, Homo sapiens
  misc_feature 6, 29, 44, 117, 157: n = A,T,C or G
gggggncccactggaggaagcgaaactcntaactttcccaagangctcccgtgaattgctggcagaacctggggccagagcccaggccccactctcaggccagcgctgcttcctggntcctaccccgcctccagtgataaggaagggggtgccctanagcaccccccacaccgccgaaaatacacactctgtttcttacctgccacaactcttcggatctcactcacaaaagtctggaggtaatatgggacacctgggctgtaatgggacgagagcccatgacctccgaaatccatggcaacgtaataaaagtctgaaac

SEQ ID NO: 40581 - DNA, 245 bp, Homo sapiens
  misc_feature 2, 20, 60, 164, 178: n = A,T,C or G
cnccccgggaacctcggccnctctggccggggaggccgtgaggcagccagcgcaggggcntctgctgagggggcaggcggagcttgaggaaaccgcagataagtttttttctctttgaaagatagagattaatacaactacttaaaaaatatagtcaataggtnactaagatattgcntagcgttaagtttttaacgtaattttaatagcttaagattttaagagaaaatatgaagacttagaag

SEQ ID NO: 40582 - DNA, 426 bp, Homo sapiens
  misc_feature 147, 148: n = A,T,C or G
gctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggnngggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgtttgaaggcacaagcacagagtcagaaagctaaacaaaaaaatgaaacttttttgagtaataaaaatgaaaaga

SEQ ID NO: 40583 - DNA, 198 bp, Homo sapiens
  misc_feature 8, 27: n = A,T,C or G
agcctagnctgggacgcttgaaaagantgataaaatgaagccttgccaccaattgcccttgtggcaaatggaaacggataaaaataggctcactttaaggagaattacttggggcccagctgaaagtgaacaccctaatgtgtaagaatgtcatcttgttttatttgtattctcctgttttgttgaaggttgtttctt

SEQ ID NO: 40584 - DNA, 247 bp, Homo sapiens
  misc_feature 19, 24, 40, 243: n = A,T,C or G
cggaactgaagccctgatnaaganggacggccgggggcanttcgtattgcgccgctagaggtgaaattcttggaccggcgcaagacggaccagagcgaaagcatttgccaagaatgttttcattaatcaagaacgaaaatgggaggaagcaaaagactctgtacctattttgtatgtgtataataatttgagatgtttttaattattttgattgctggaataaagcatgtggaaatgacccanacct

SEQ ID NO: 40585 - DNA, 500 bp, Homo sapiens
  misc_feature 13, 23, 32, 41, 66, 75, 86, 107, 153, 204: n = A,T,C or G
acccccgggaccncggcccctcnggccggggngtgtttaantggaaactggacggaaccacctcantgcaaagantctacaggaanatgtgggccccctccacctcntgacaactggggacacttacttccttcccgttgtcagtatactgcnccagcttcatcagttgagtaccaatgccagaacttgtattaacttgagggnaacaagcgaataacatgtagaaatggacaatggtcagaaccaccaaaatgcttacatccgtgtgtaatatcccgagaaattatggaaaattataacatagtattaaaggtggacagccaaacagaagctttattcgagaacaggtgaatcagttgaattttgtgtgtaaacggggatatcgtctttcatcacgttctcacacattgcgaacaacatgttgggatgggaaactgggagtatccaacttgtgcaaaaagatagaatcaatcataaagtgcacacctttattcagaact

SEQ ID NO: 40586 - DNA, 258 bp, Homo sapiens
  misc_feature 1, 22, 62, 71, 102, 166: n = A,T,C or G
nccccccgggaacctcggcccnctctggccggggaggccgtgaggcagccagcgcaggggcntctgctganggggcaggcggagcttgaggaaaccgcaganaagtttttttctctttgaaagatagagattaatacaactacttaaaaaatatagtcaataggtnactaagatattgcttagcgttaagtttttaacgtaattttaatagcttaagattttaagagaaaatatgaagacttagaagagtagcatgag

SEQ ID NO: 40587 - DNA, 133 bp, Homo sapiens
  misc_feature 17, 32, 42, 48, 130: n = A,T,C or G
ggccgggcaaccctggnaggcgcggtggcctnctgcctgtantcccancactttgggaagcccaaggcgggcggatcactttgaggtcaggagttcaagaccagcttggccaacatgatgaaaccctgtntct

SEQ ID NO: 40588 - DNA, 258 bp, Homo sapiens
gggggaaagatgagtttaatttggggatattttgaatttgaggtgcctgtgggatgtctatttggagctagcctgtagacattggattaggggagagatgcacatgctacagatactgatagggtaacagttagcagtaatggtaagtgcagccattgcaatggttgtctgtaatgtgagaagacaagatgaagaatagaaccctgcagatcacccatgtttaagagacagggcaggttagaagaaaggggaccttgc

SEQ ID NO: 40589 - DNA, 472 bp, Homo sapiens
  misc_feature 105, 362, 471: n = A,T,C or G
ggcgtcaaagtatttagctgactcgccacactccacggaagcaatatgaaatgatctgctgcagtgctctgagccctaggattcatctttcttttcaccgtaggnggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgcnccgacgttactcggactaccccgatgcatacaccacatgaaacatcctatcatctgtaggctcattcatttctctaacagcagtaatattaataattttatgaatttgna

SEQ ID NO: 40590 - DNA, 329 bp, Homo sapiens
  misc_feature 156, 263: n = A,T,C or G
gtgtaaccctatatagaaagcattaggccctaactttcttaactgggtcatgtttcttgttaatttaccaattgtatccagattctcaactggagctaggatatacttagggcctaagttttctaactgtggacctgagctgggacccacagtgtnctctgttccattttcatcttcatgattttgtggaaagaaacctttataagtcagtaacctaaaagccccaagttagccaccctgctacctgagaggctgaggcaggnaggattgcttaagccaaagagtttgagcccagcctaggcaatatagtgagaccacatctcttattt

SEQ ID NO: 40591 - DNA, 113 bp, Homo sapiens
  misc_feature 63, 107: n = A,T,C or G
aaatgtgattgcagcttttcaatgttagccacagtgtattttttcacttgtactaaaattgtntcaaatgtgacattatatgcactagcaataaaatgctaattgtntcatgg

SEQ ID NO: 40592 - DNA, 368 bp, Homo sapiens
  misc_feature 2, 7, 51, 55, 61, 69, 74, 157, 188, 215, 311, 367: n = A,T,C or G
cnccccnggaacctcggccctctggccgggcgaggagtacccctttctgcntttntttgtntacttctntttanaaatctgtttggtggccaggcgcagtggctcacgcctgtaatcccagcactttggggggccgaggcgggcagatcatgaggtnaggagatcgagaccatcctggcagacgtggngaaaccctgtctctactaaagatacanaaattggctgggcatggtggcaggcgtctgtgatccaagctacttgggaggctgaggcgggagaatcgcttgaacccgggaggcgggaggttgcantgagccgagatcatgccactgcactccaacctggcaacagagcgagactgtctcana

SEQ ID NO: 40593 - DNA, 249 bp, Homo sapiens
  misc_feature 2, 40, 126: n = A,T,C or G
cncccccgggaacctcggcccctctggccgggggagaacngtgggcttcaccaaggacgtgggcaacactcaagtttctggtctgcgcagactgtgaaattggaccaattggctggcattgcctanatgacaagaacagtttctatgtggccttggaacgagtttcccatgagtaactgaggggaggggtactcagctccatctccaaagataaacctactccccacaagaactggcctttaatgtggt

SEQ ID NO: 40594 - DNA, 471 bp, Homo sapiens
  misc_feature 214: n = A,T,C or G
agagactgttggcccgggccgagaaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcnttatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatg

SEQ ID NO: 40595 - DNA, 419 bp, Homo sapiens
  misc_feature 6, 18, 71, 129, 175, 282, 326, 409, 413: n = A,T,C or G
gagacntttttcattacnttacaaatattgatatgctggagggatttgcctacttgagaactcaggaaggngggaaaattcatctggaattactacccaatcaaggaatgctgatcaagtaagcatgtnctcttttgctcttccatgctgagtgctcaccttttgtgtctttgtntgaagtatttgtaaatgtctatacctatcaaaaatttaatacaaaggactttaaacctggtctctgttatgatagtttgattctgggtaccttttgaaaaacttgcntttccttaactacatttcttaaaacactttgcttaaattggggngttttttttgtgcacatttgcaactttttcactagacaaaagtctcattcatgatatcttttactttcaaaaattataggggngagnctatta

SEQ ID NO: 40596 - DNA, 498 bp, Homo sapiens
  misc_feature 8, 17, 40, 100, 135, 141, 158, 172, 215, 399, 437: n = A,T,C or G
ccgggacnctcggcctntacggccgggcaaattcaggaantacagagaacaccacaaagatactccttgagaagagcaactccaagacacactaattgtnagattcaccaaagttgaaatgaaggaaaaaatgtnaagggnagccagagaagtcgggntacccaaaaagggnagcccatcagactaacagctgatctctcggcagaaactctgcnagccataagaaagtgtggtccaatattcaactttcttaaagaaaataattttcaatccagaatttcatatccaaccaaactaagcttcataagtgaaggagaaataaaatcctttacagacaagcaaatgctgagagattttgtcaccaccaggtctgccttataagagcccctgaaagaggcnctaaaaatggaaagcaacaactggtaccagccactgcnaaaacatgccaaattgtaaggaccactgatgctaggaagaaactgcgtcaactaacaagca

SEQ ID NO: 40597 - DNA, 265 bp, Homo sapiens
  misc_feature 1, 15, 58, 137: n = A,T,C or G
nccccccgggaaccncggcccctctggcccgggccttggctgacgtgtcctaaggttnttagcctgttcctccctttcttcaccctccccttttttcttctattaatcaagagaaacttcaaagttaatgggatggncggatctcacaggctgagaactcgttcacctccaagcatttcatgaaaaagctgcttcttattaatcatacaaactctcaccatgatgtgaagagtttcacaaatccttcaaaataaaaagtgatgac

SEQ ID NO: 40598 - DNA, 472 bp, Homo sapiens
  misc_feature 137, 169, 254, 275: n = A,T,C or G
gctttttctttggcaagatggcggagtacgacttgactactcgcatcgcgcactttttggatcggcatctagtctttccgcttcttgaatttctctctgtaaaggagatatataatgaaaaggaattattacaaggnaaattggaccttcttagtgataccaacatggnagactttgctatggatgtatacaaaaacctttattctgatgatattcctcatgctttgagagagaaaagaaccacagtggttgcncaactgaaacagcttcaggcngaaacagaaccaattgtgaagatgtttgaagatccagaaactacaaggcaaatgcagtcaaccagggatggtaggatgcactttgactacctggcggacaagcatggttttaggcaggaatatttagatacactctacagatatgcaaaattccagtacgaatgtgggaattactcaggagcagcagaatatcttta

SEQ ID NO: 40599 - DNA, 365 bp, Homo sapiens
  misc_feature 4, 129, 209, 229, 360: n = A,T,C or G
agantgaggttaacttagagttgggagttgatttattaagtacagtatacctctcaacagtttataaataatatgttgaattatgtcagtgtgggcagcagtagaatactaaaaggaaaatgtcatgtnaagcaatttcagaacattaactgaactattttcaaagcagaaaaattgacattgctgcctttaagaataccatgaatgtnagaaattgaaagaaattgtnaaatatcacataatatagaaatggcagttcaaagagaattgtggcagatgttgtgtgtgaactgtgtgtttctttgccacatgtgttgtatttgaaaagttttacagtaagtttaaaataaaacattctgngacga

SEQ ID NO: 40600 - DNA, 476 bp, Homo sapiens
  misc_feature 4: n = A,T,C or G
gctnttatggaccggggggaacaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgt

SEQ ID NO: 40601 - DNA, 374 bp, Homo sapiens
  misc_feature 20, 66, 105, 110, 115, 148, 170, 185, 204, 357, 366, 368: n = A,T,C or G
atccctactaggcttgctcnctttcatccttcactatagatacaacggactttgactaaaagcagngaaggggatttgcttccttgttatgtaaagtttctcggngtgtnctgtnaatgtaagacgatgaacagttgtgtatagtgtnttaccctcttctttttcttggnactcctcaacacgtntggagggatttttcaggtntcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtnccttaagtngngggaga

SEQ ID NO: 40602 - DNA, 469 bp, Homo sapiens
  misc_feature 67, 75, 85, 91, 111, 178, 413, 421, 433, 468: n = A,T,C or G
atagttgactctaacatttcctcatttttctctgaatttgctttttaaaaaactcttccccttgccnttcccttncccattccanattgtnactgcttctttccagctgcntcagaagaaggggactttccatgtaggtgttattctcagaaaaggccagaaaagaccaggtcatggnggggatgatttgctccaagcataaaagagaattgtgatggttcaggaagactggaaaataacgagactggaaagaaatgagaagggcttcagaggaatggcacattgaaataaaaggaagtggtaagaacaggaaaacaagtggaatgaaaggagcacacagtgggcagggatgattggatagactgtggaataaagataatttgggaaaaaaatgggcagaaaataagagaggnttcatggntccattattgtntattctattcctcctactaggttaacatttcccana

SEQ ID NO: 40603 - DNA, 469 bp, Homo sapiens
  misc_feature 54, 61, 75, 79, 189, 230, 253, 271, 284, 418, 428: n = A,T,C or G
ggctgtagtggcttcgtcttcggtttttctcttccttcgctaacgcctcccggntctcgtnagcctcccgccggncgtntccttaacaccgaacaccatgccttcaattaagttgcagagttctgatggagagatctttgaagttgatgtggaaattgccaaacaatctgtgactattaagaccatgtnggaagatttgggaatggatgatgaaggagatgatgacccanttcctctaccaaatgtgaatgcngcaatattaaaaaaggtnattcagtggtgcncccaccacaaggatgaccctcctcctcctgaagatgatgagaacaaagaaaagcgaacagatgatatccctgtttgggaccaagaattcctgaaagttgaccaaggaacactttttgaactcattctggctgcnaactacttanacatcaaaggtttgcttgatgttacatgcaagactgttgcc

SEQ ID NO: 40604 - DNA, 212 bp, Homo sapiens
  misc_feature 182, 195, 209: n = A,T,C or G
actaaagaagtaggtgtttgggcctggcctgatggctcacacctgtgatcccaaagtgctggaattacaggtgtgagccatcgtgccctgccgaaattgaattttctaatgacagaattaaaaacatcagaaggcttagtttaggaaggaaagtgacaggatggattttaggcaggtttggnttgagctgatggncaagaaattgggtntct

SEQ ID NO: 40605 - DNA, 378 bp, Homo sapiens
  misc_feature 105, 151, 169, 272: n = A,T,C or G
tgcggtggcttatgcttgtaatcccatcactttgggaggctgaggcacgtggatcacttgagctcacgagttggagaccagcctgggcaacacagggagactgtntctacaaaacattttttaaataataaaattagccagacaccgtggngtgcgcctgtagtcccanctgcttgggaggctgaggcaggaggatcatttgagcccaggagattgaggctgcagtgagctgtaataaagatactgtggccgggtgctggctcacgcctgcnatcccagcactttgagtggccgaggcaggcggatcacaaggtcaggagttcaagaccagcacggccaagatggtgaaccctgtctctactaaaaatacaaaaatta

SEQ ID NO: 40606 - DNA, 250 bp, Homo sapiens
  misc_feature 93, 113, 117, 151, 201, 209, 210: n = A,T,C or G
aaggtggaacaactgaactcatagataattgattagtgggtcggtgttaatggaatgtggactctgatttttaccctgtttttgagtattggnctgcaacttcagtaaaagcntgcntacaaatctttagatgatacgtgtcttggagggntaatttagatattcaataaaattgtcaggattctgcattcacaaaatgtnaaagtggnntgtaagactacaatagaaactttcttgagaatcgttccct

SEQ ID NO: 40607 - DNA, 298 bp, Homo sapiens
  misc_feature 97, 112, 115, 188, 230, 235, 270, 295: n = A,T,C or G
atattctatttccttttaaatttacctggttcattttctttaccactacagtgctttataatgatataaactacggggaaaggaaagaaagagtggngatagaaacattgtnggncaaaagctgacacataaagactggcagtggagtagagattgggaagagtgttattattttacataacattgtntataagtagtctcacaaaatatttaattttaaaatttttgtnttgtnatttataattcttgtgactttgaaatatcagaatntttatgtttaccttttggggttgtnttg

SEQ ID NO: 40608 - DNA, 470 bp, Homo sapiens
  misc_feature 428, 439: n = A,T,C or G
ggctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttanacatcaaaggnttgcttgatgttacatgcaagactgttgcca

SEQ ID NO: 40609 - DNA, 356 bp, Homo sapiens
  misc_feature 106, 343, 345, 353: n = A,T,C or G
gaagttggggtagcctcggcaggagtcccactcctcctggggtactgcctgccaccaagagctcccccacctgtaccaccatgtgggactccaggcaccatctgtnctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctaaggctggggctacatttggcttctgtactggctgaggananggaagganatg

SEQ ID NO: 40610 - DNA, 117 bp, Homo sapiens
  misc_feature 47, 50, 56, 65, 85: n = A,T,C or G
aactagaagacgttcaagccctggatgacaccgaaaggggttcaggnggntttggntccactggnaagaattaaaatttatgccnagaacagaaaacaagaagtcctacctttttct

SEQ ID NO: 40611 - DNA, 123 bp, Homo sapiens
  misc_feature 84: n = A,T,C or G
caaaagaaatgcttaaagatctcagttggctttatggtgattctagaactgggcaatacttgccaccttaaattagaataaggnttccaatgagttacagcagaggagattggcttcatagac

SEQ ID NO: 40612 - DNA, 146 bp, Homo sapiens
  misc_feature 20, 37: n = A,T,C or G
caccccgggaattcggcacntatggccggctccttcntcctgtaaaggtgaacaataaaaacccaattatggggctgcttttgtcacactagcctagagaatgtgttgaaatttaactttgtaagcttgtatgtggttgttgatct

SEQ ID NO: 40613 - DNA, 482 bp, Homo sapiens
  misc_feature 138, 276, 344, 427, 458: n = A,T,C or G
gatggctagtgtttaatgactacaggtttccaggctccctttaatcttgggagcaaataaatctactattggacttctccctgcgtgacttttaacatttctgatactctctcttcttcctctttacagaagagaggnatgataactgaagttgtactttgcatattgaagtttaaagatacttcctctccccttttcacccctatttcaaatgatgtgataaaatcctcttgataggctatatggagaacatttgtcaatagttttatctatgcntggaagtcttcaaaaagtatatcttggattgtctaaaactgaatagatttcttatttatctgaaggtntacagactgccaacattttagacttatctctcagtctctgccactgaacttttatatatggctgctatcaaaatataaccggnttattttcatatttggaactaatataacagnatcacaaaatcttttacagtaaga

SEQ ID NO: 40614 - DNA, 472 bp, Homo sapiens
aagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggttttgggtttcacatcttcaatgcgaggaatggatgcagtttgaaaatgatcacacttgtaaagtttgggacttatagacttcttgttctgatgtcacgtccttgttcaccaaacag

SEQ ID NO: 40615 - DNA, 299 bp, Homo sapiens
  misc_feature 83, 101, 111, 114, 122, 207, 248, 267, 296: n = A,T,C or G
gaggtccaagtaaaccgctagcttgttgcaccgtggaggccacaggagcagaaacatggaatgccagacgctgggatgctggnacaagttgtgggactgcntgctactgtntanagcttgtntcaatggatctagaacttcatcgccctctgatcgccgatcacctctgagacccaccttgctcataaacaaaatgcccatgttggncctctgccctggacctgtgacattctggactatttctggtntattttgtggccgagtgtnacaaccatataataaatcacctcttccgntgt

SEQ ID NO: 40616 - DNA, 467 bp, Homo sapiens
  misc_feature 101, 106, 196, 328: n = A,T,C or G
gggttcctcttgttttggttattttgtgtagcagtttaatcagtggataactgagcctgtttcctcttagctttctagacttcttaacagaaaaaacagtntgggntcaatagcattttatgattctacaatattttgtcacctagctggaagttgcaataaaaattccttatgaaatatatggttttcatctgtnattgaaggaaatcatagaaagtttgctgaaagcaaagggctaagcttatgaaggaatgcctcctttgttacacactcaagaatttgtcagcacacaattaattgcagccatagtacctttttgcgtaatgtntgggatattcagtagcccaggattgctacaaaaagggcctttgagaaaattaatttgtgcttgcttttatcccctctcagaaagacatcactaaaggccccattaaaaatctggcccctaaaagttcaacttttgtaga

SEQ ID NO: 40617 - DNA, 194 bp, Homo sapiens
  misc_feature 94: n = A,T,C or G
gtctataagaaggagaaagctcgagtcatcactgaggaagagaagaatttcaaagccttcgctagtctccgtatggcccgtgccaacgcccggntcttcggcatacgggcaaaaagagccaaggaagccgcagaacaggatgttgaaaagaaaaaataaagccctcctggggacttggaatcagtcggcgggcg

SEQ ID NO: 40618 - DNA, 387 bp, Homo sapiens
  misc_feature 372: n = A,T,C or G
gctttcccctggctggcagcgcggaagccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagctgaggctccaagagtgtggcccgccgggtcctccaagccctggaggggctgaaaatggnggaaaaggaccaaga

SEQ ID NO: 40619 - DNA, 275 bp, Homo sapiens
  misc_feature 150, 188, 212: n = A,T,C or G
acagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggnttcactgtgaatgcgtgacaataagatattcccttgtncctaaaactttatatcagtttatnggatgtggtttttcacatttaagataattatggctcttttcctaaaaaataaaatatctttct

SEQ ID NO: 40620 - DNA, 472 bp, Homo sapiens
  misc_feature 36, 76, 142, 149, 200, 227, 365, 399: n = A,T,C or G
ctacaaatgcaatgcaattccctcaaaataccaccntcattcttcacagaactagaaaaaacaatcctaaaattcntatggaaccaaaaaaaagcccacatagccaaagcaagactaagcaaaaagaacaaacctggaggcnttaggtnacctgactttatactataaggccaaagtcaccaaaacagcatgatactggnataaaaacagacatatagacaaatgcnacagaatagagaacccagaaataaagccaaatacttacagtgcaactgatctttgacaaagcaaacaaaaacataaagggagggaaaggacaccctattcaacaaatgggggctgggacaattggcaagccacatgtngaaaaatgaaactggatcctcctctcttaccgtntataaaaatcaactcaagatggatcaaagacttaaatctaagacctgaaaccataaaaattctagaagataac

SEQ ID NO: 40621 - DNA, 112 bp, Homo sapiens
atgcaatctgatgagatgagctcagatttaaaaatctcaaaagcacgtttattgtaacaagaattgttatgtattaatactgcagttttcaataaagattgacttgtgttac

SEQ ID NO: 40622 - DNA, 180 bp, Homo sapiens
  misc_feature 40, 56, 82: n = A,T,C or G
cttaaagtgtgcctaaattagaagttataagttatttccntaataaaatctggacntaaatgtctaaataccagtcattgtncataccacgctttttaaattcttattatttccagggcatcaaaatatctgcctttactgggagtactttgtattttctatcagcaaaatcaggatacc

SEQ ID NO: 40623 - DNA, 500 bp, Homo sapiens
  misc_feature 6, 10, 39, 128, 129, 149, 186, 203, 207, 244, 332, 406, 448: n = A,T,C or G
agcttnttanattttcatttatggcaagttataattacntgtaaaagtagtcttgaacaggtaaatattgagcctttttaataggatgtaacctttgtggagcccaaattctaaagaacaagattggnnatccaattaaactacatgcnaaataagtgtgatacatgcatctacaaaaacagtgtnctcattttttctgggtntgcnaatgattggattgtgtctccttgggtctctgtgtgtncaggtaaagaatagtttacagatccctgctgaaattaaaaagaaaaaaatgctcatttggaaagtgcccagtgatgaactggtttgcngaataatctttgaagaagattaatcaggtttttatctttttagaagagatgggtccctggccagaagaaaaggnggggagaaaacatttaaactgtcagttggagcaattcaaggnataatgcttatgtgatggagacctcaattataaattaggtgctagatacaag

SEQ ID NO: 40624 - DNA, 467 bp, Homo sapiens
  misc_feature 201, 411: n = A,T,C or G
attccaaattgacccacagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcttgaatgactactgggtacataacgaaatgaaggcngaaataaaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcnagaaataactaaaatcagagcagaactgaaggaaatagagacacaaaaaacccttc

SEQ ID NO: 40625 - DNA, 399 bp, Homo sapiens
  misc_feature 121, 150, 186, 187, 223, 226: n = A,T,C or G
cagttaagtgcatgcaaaaagccccaaatgaagggattctatccagcaagatcctgtccaagagtagcctgtggaatctgatcagttactttaaaaaatgactccttattttttaaatgtntccacatttttgcttgtggaaagactgtnttcatatgttatactcagataaagattttaaatggnnttacgtataaattaatataaaatgattacctctggngtngacaggtttgaacttgcacttcttaaggaacaaccataatcctctgaatgatgcattaattactgactgtcctagtacattggaagcttttgtttataggaactttgtagggctcatttttggtttcattgaaacagtatctaattataaattagctgtagatattcaggtgc

SEQ ID NO: 40626 - DNA, 310 bp, Homo sapiens
  misc_feature 188: n = A,T,C or G
ggagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggntcagtgactgtggttgctcttcttcaagccagctgatacctgtgcatactgcaggcatctaaattagaagacctgcgagtaaaactgaagaaagaaggatattctaatatttcttatatttg

SEQ ID NO: 40627 - DNA, 210 bp, Homo sapiens
  misc_feature 90, 93, 102, 114, 138, 185, 195: n = A,T,C or G
gtctgatattggatttaagaacagttaaatcttactgcttggaaactgatctttaacaagctagttttcctgctttaaaataatagtgtngtncgtgatgtnaatttccctgtntcacttgacaattacagcaggggnagcttccctgagcacaggatgaggatcagtcagcttgagtatctggnacagaaggcnagctccctgtgcacc

SEQ ID NO: 40628 - DNA, 371 bp, Homo sapiens
  misc_feature 88, 99, 292, 323: n = A,T,C or G
atttgatattctcttatatgttatagtaatgtaacgtataaactcaagcctttttattctttgtgattaaatcctgtgttaaaatgtnacaaaacaggnaccagcattctaattagatttactatatcaagatatggggcaaataggactactagagttcattgaacactaaaactatgaaacaattactttttatattaaaaagaccatgggtttaacttatgaaaatccaaatgcgggatagtaatttttgtgtacttttttaaccaaactgaatttttgaaagactatngcgggtgtgtaaaaagaaagaaaagtgtgtnttatctaatacctgtgagtgagggtgtcatattctggaaaatttaata

SEQ ID NO: 40629 - DNA, 371 bp, Homo sapiens
  misc_feature 16, 103, 137, 172, 188, 273, 292, 314, 349, 369: n = A,T,C or G
attctcagagataccntcagagaacaaacactaatgttaattgcccaattgagtgcttcatgcctttagatgtacaggctgacagagaagattcccgagagtnaatcctctttccaatccagaggaacaagcatgtntctctgccaagatccatctaaactggagtgatgtnagcagacccagcttanagttcttctttctttcttaagccctttgctctgggaggaagttctccagcttcagctcaactcacagcttctccaagcatcaccntgggagtttcctgaggggntttctcataaatgagggctgcncattgcctgttctgcttcgaagtattcaataccgntcagtatttaaatgaagtantt

SEQ ID NO: 40630 - DNA, 156 bp, Homo sapiens
  misc_feature 2, 52: n = A,T,C or G
gnggggaacctggcgctaaaccttcgtagacgacctgcttctgggtcggggnttcgtacgtagcagagcagctccctcgctgcgatctattgaaagtcagccctcgacacaaagggatacaactataaatgtaataaaatttatgtgctagaagtt

SEQ ID NO: 40631 - DNA, 162 bp, Homo sapiens
gtttggccgcttgctttttgggagaagacttaatctgatttatgaaataaccttgggttttttgtttgtcgtcttttatttaatgttggcaactaccatgtaaatctaagtattaggcccctgtgaatataaggcaatttccaatttttccaatcagaagat

SEQ ID NO: 40632 - DNA, 285 bp, Homo sapiens
  misc_feature 12, 184, 207, 249, 261: n = A,T,C or G
attaccgcaagnaataaaaaagaaatcctatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgngctagaatactttttaaaaggtnttttgaataccattaaaactgcttttttttttccagcaagtntccaaccaactnggttctgcttcaataaatctttgc

SEQ ID NO: 40633 - DNA, 304 bp, Homo sapiens
  misc_feature 202: n = A,T,C or G
accctggaattcactctgttgggttttgtttgtttgtttttttggggggaggggtttgtttgtttgtttgtttttgagacagagtcttgctgtgtcgccaggctggagtgcagtggtgccatctcggctcactgcaacctctgcctcctgggttcaagcgattctcatgcctcagcctcccaagtagtgcatgtcctcccancctctcaagaggctgaggtgggaggatcacctggagccaggagtttgaggctgcagtgagctgtgatcctgccactgtactccagcctaggaaactctgtct

SEQ ID NO: 40634 - DNA, 452 bp, Homo sapiens
  misc_feature 140, 384, 392, 403: n = A,T,C or G
caccccttaatctgcatgcaattacaagtgggtataaatatgactggaaacccctgagctgctaccctctgcctaaggggtagtcctgcactgcaggagcagtcatggagctgtaacactgcctcttcaattaagctgtntgcttctacctctggcttgcccttgaattctttcctgggcaaagccaagcaccctcgtgggctaagctccacttttggctcgcctgccccgcatcaagagcacaaccagctctccctggactcttcatctgggaatggacaaggaagacagcattacagtgtgtggagccccccaggccttgatgtgggcatcacgtggctgagatggcttcatctgtgaaaaggagccagaactctttatcangctaggcngggcttttgtntaactggtccctctggctgcttttgttgacagataaaggagtattttac

SEQ ID NO: 40635 - DNA, 278 bp, Homo sapiens
gaacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtg

SEQ ID NO: 40636 - DNA, 303 bp, Homo sapiens
  misc_feature 35: n = A,T,C or G
gagccagactagaggggaaactatcacctaaaatngtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacat

SEQ ID NO: 40637 - DNA, 469 bp, Homo sapiens
  misc_feature 5, 8, 9, 14, 18, 22, 27, 32, 45, 46, 52, 53, 66, 78, 99, 410: n = A,T,C or G
agganccnnccgcntcanaccnactangactntagactcaagcanncttatnnatgcggccgctantaaagctcactnggccacattaagccctatagngagacccacttctaccaaaaagccaaaaacaatgcctagagtgagaaaaccgaagacgacaccaactccccgcaagatgacatcaacaatgccagaattgaaccctacctcaagaatagcagaagccatgctccaaaccaccaccagacctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcnttatcatcaatcccatgctttccgatgagaccaatatatgcaatggtaagccagtagat

SEQ ID NO: 40638 - DNA, 303 bp, Homo sapiens
  misc_feature 98, 142, 168, 251: n = A,T,C or G
attattaaataaggaaagcattttgtgatatgtggaagacgctatgtgaagttttacctatcttctcaaagaccttttcttttgtattttcttttggngtttcttaaagccaaacaaagaaatgttcttaaggagacagggngggtttttctgtgggcctttgttggnttttctgtgggccatcgccctctaatggaattgatctctggctgtttgatttttttcatattgtatttttaaaatttgttgtncagtgccctgtgagcaccaagtaccactagatgaataaaacgtattatatct

SEQ ID NO: 40639 - DNA, 417 bp, Homo sapiens
  misc_feature 13, 60: n = A,T,C or G
cagatgccaaagnccccaaatcacacttgagtcgtctcctcaagttagaatgagcaatanaaaaccagacagccctgtatctatgggaatgttgcttgcatcagagccaccacaccttgctgtgaggttgatcggtttctcgcagctggaaatagttgcttcccgccccccatcttcctcactcttttaaactctcaaaaatcccccagcctcccaaatttgttttaatttttaagagaattcttttctacaaaagagggaaaccttctttcaaatggcccttcataaatttccctaaagaggtttttatctctgatagaaatatgaaaaacagataaccagataattgccctctatctaggctttaaacacttattcatacattgaatttctgcaagttacagatgattgttgctg

SEQ ID NO: 40640 - DNA, 263 bp, Homo sapiens
  misc_feature 131, 178, 247: n = A,T,C or G
aaagcctggaatgatatcaaaaaggtctatgcctctcagcgaatgagagctggcaaaggcaaaatgagaaaccgtcgccgtatccagcgcaggggcccgtgcatcatctataatgaggataatggtatcancaaggccttcagaaacatccctggaattactctgcttaatgtaagcnagctgaacattttgaagcttgctcctggtgggcatgtgggacgtttctgcatttggactgaaagtgctntccggaagttatatga

SEQ ID NO: 40641 - DNA, 415 bp, Homo sapiens
gaatcttagttcaactttaaatttgcccacagtaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatactcat

SEQ ID NO: 40642 - DNA, 238 bp, Homo sapiens
cgaactcctgggctcaagcagtcctcccaccttggcctcccatagtgctgggattacaggcatgagccactgtgcctagccagaaattggcttaaaatgcagatttttggaccctgtccccagcaaaaagattcggtagaaatctttattcgtagccagtttactgtgttgcaggtggtccccagtttaactttgagtaatgctgtcttgttgttaaaataatcagatttaattatat

SEQ ID NO: 40643 - DNA, 266 bp, Homo sapiens
agtcctcccacctcagcctcctgagtagctgggattacaggtgtgtgccatcaagcccggctaatttttgtatttttagtagagatggggtttcactatgttggatggctgatctcgatctcctgacctcaggtgatccgcccaccttggcctcccaaagtgctgggattacaggcatgagccactgtgcccggcctgtttccttgaattggatcaaaatatgatctatacattacaatcaggtaatgtttcttacctgatttttg

SEQ ID NO: 40644 - DNA, 281 bp, Homo sapiens
  misc_feature 269: n = A,T,C or G
caccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctnttgctgagaaga

SEQ ID NO: 40645 - DNA, 402 bp, Homo sapiens
  misc_feature 32, 334: n = A,T,C or G
gtctccaaaaaaaagtccacatcttcatgaancctcaaactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaanaaaacatggcattgagtgtgctgagtccagacaaatgttatttatatacacatccaaatttgaagaga

SEQ ID NO: 40646 - DNA, 282 bp, Homo sapiens
  misc_feature 211, 219, 257: n = A,T,C or G
tagtagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctnaccattcncctttctcccttccctcctcttgctcctcaagtaagangtgcagagatgaggtccttctggac

SEQ ID NO: 40647 - DNA, 342 bp, Homo sapiens
  misc_feature 30, 31: n = A,T,C or G
gaatgccaggggacttggatctgagctaanngacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttga

SEQ ID NO: 40648 - DNA, 389 bp, Homo sapiens
  misc_feature 8, 34: n = A,T,C or G
acatagcnaaatgcgaaacaggttggccgccttnaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatac

SEQ ID NO: 40649 - DNA, 128 bp, Homo sapiens
ctttgtttgtttttgtttttggttccgttttttgagagggactctggctctgtcgcccaggctggactgcagtgagccaagatcgcgctgttgcactccagcctgggcaacaagaacgaaactgtctc

SEQ ID NO: 40650 - DNA, 488 bp, Homo sapiens
gatttcctgttagcctatgaaatgttattgttctataaaaataactttaaactgattcaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcat

SEQ ID NO: 40651 - DNA, 423 bp, Homo sapiens
atttcagcaggagctgtgttgttttctctatgcccttttgtttacatgtgaatataatgtaactatatattttttcttttttcttcttcagtcatagtcttctccagcctgggcgacaaagcaagactttgtctcaaaacaaacaaacaaaaaacccacatacacactagaaagatgggtgggattacaggaaggcagatgcagaccctgaagcctgcgatggagctgattttgtatttccagcattaacaagttcctcccatgttcttccatttgctcacagacctcccacagcccagtgtgccaggacgtgctgaaattcatcagtcagtggtgtgggagggctccccagcaccagcttttcctttcagtagtcggtagagctgaggaagagttagggcctctccctcattaaagttttat

SEQ ID NO: 40652 - DNA, 161 bp, Homo sapiens
  misc_feature 10: n = A,T,C or G
gactcttagncggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccg

SEQ ID NO: 40653 - DNA, 398 bp, Homo sapiens
  misc_feature 24, 25: n = A,T,C or G
cgctgctgataaagacatacccgnnactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatgc

SEQ ID NO: 40654 - DNA, 463 bp, Homo sapiens
accgtgaggatggtgtgaccccatatatgattttctttaaggatggtttagaaatggaaaaatgttaacaaatgtggcaattattttggatctatcacctgtcatcataactggcttctgctgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaaga

SEQ ID NO: 40655 - DNA, 322 bp, Homo sapiens
aaggagctgaacttgtcaaggtttagatgtggtaaagcaggccaggcatggtgactcatgcatgtaatcccagcattttgggaggccaaggcaggaggatcacttgagcccaggagtttgaaagcagcccgggcaacatagtgaaaccccatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtct

SEQ ID NO: 40656 - DNA, 204 bp, Homo sapiens
  misc_feature 32: n = A,T,C or G
agtctcctggaagagcagttccagcagggcangcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttccctc

SEQ ID NO: 40657 - DNA, 235 bp, Homo sapiens
  misc_feature 7: n = A,T,C or G
cacaaantatgtgtaagattgttacacagagtaatcataaacattgctgagagaaattaaagaagacctaaatcaatagagggacataccatgtttatagattagagactaaatattgtaaagaggaagattcctcctaaattgatctatatatttaaatctaattctgataaaaatcctgcataaaattttgtggaaattaaaaagttgttttttaaaatgtatatggagatgc

SEQ ID NO: 40658 - DNA, 500 bp, Homo sapiens
  misc_feature 24: n = A,T,C or G
tctttaaaagaggtaagagcaacncgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattct

SEQ ID NO: 40659 - DNA, 490 bp, Homo sapiens
aacaaacggcttgagtatatgaaatggaaaattgaggttctgtgggttggaacagagatcttcagtacaaagttgtgaccttggaatggaaaggactgaaaaaaaatcatcagaacagaagagacaaggaagctgtgtcttagaaaaagaatgtctccttcaaaaacacatctctatggatttgtacctcatttaggtttgggaattgaatttgtactacttgtgtagtatggaaaaatcacaacttgaaaaattaactacagagagcccagattactgatacttctaaagcacctggcagaatctgttacaaacttcttaggagaaagataccattcaaccaagtttcacaagattcctaaacataaatatcttctaaagattaactcacaacctcaaactataaaacataagaacaaaatcccccacaagtgagagttagcaaacacaaagagcaggattagaataagacctaaaagtgatggaacta

SEQ ID NO: 40660 - DNA, 127 bp, Homo sapiens
tagatgaagcaacgcagctagactgcgagaattaatgtgaattgcaggacacattgatcatcgacacttcgaacgcacttgcggccccgggttcctcccggggctacgcctgtctgagcatcgcttg

SEQ ID NO: 40661 - DNA, 432 bp, Homo sapiens
  misc_feature 5, 30: n = A,T,C or G
ggcgncattggagtcaagatggaggagtantcgcgagtaccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctct

SEQ ID NO: 40662 - DNA, 413 bp, Homo sapiens
aggaacatggctgtgctgtgtgtcacagcgcaggacaacaccagatgtttctgttgggttgaatttctattgggttaaatggaattaaattaattgagtcaaactgtgctttgtgcctctgtagaaaaatttaaagagttagaaaatataggaaaatttccatggacaaatgctagaagaaaacagaatactactgcttaaaaggaaaactttaattcctgaaaagatttgtttctgtggaagactgcattcatagacaatacctaatgaagaagtatagctataataaaattattatacaagagttgatgattgaaatttttagtgaaggccaggcacggtggctcacgcctgtaatcccagcactttgggaggctgaggtgggcagatcacctgaggtcaggagttcgaga

SEQ ID NO: 40663 - DNA, 321 bp, Homo sapiens
atggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtac

SEQ ID NO: 40664 - DNA, 305 bp, Homo sapiens
  misc_feature 30: n = A,T,C or G
gggcctatgccatttctgttgtagtttgtngcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgg

SEQ ID NO: 40665 - DNA, 490 bp, Homo sapiens
  misc_feature 32: n = A,T,C or G
gtacccctaaaacataagataaaaaagagtantgaatattgagaatccaatagacagagttgagaaccagttaaacataagaaagaattagtgaattggaagataactgcccagaatgaagcataaagagaccaagaggtagaaaatataaggctagagggtcagagacattgaagctacaatcagaacaactaacatacttctgcagttccagaagattagaagagagaaaatgggccagaagcattgtggagatttttccaaaagtggtaaagtgtatcagttcatatatttttagaaaccatcaaacttcagacaagataactaaaaccaaattaatataaaatgacaggacatcaaagaccaataaaaaacctgaaaggtaactaaaggaaaagacagattatgttaaagggaataactgtctaaatgacaacctgattttcaacagacaaaaatgtagctagaattcaatggaatcatgccttca

SEQ ID NO: 40666 - DNA, 381 bp, Homo sapiens
  misc_feature 2, 19, 36, 45, 340: n = A,T,C or G
tnttatggccgaggatgtnagcactgttgctcaggnagtgacaanttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaagtaaacctggcagctatanaatacactatgtgcatttataatagctattttatatatttg

SEQ ID NO: 40667 - DNA, 126 bp, Homo sapiens
  misc_feature 31: n = A,T,C or G
ggaatgcgagtgcctagtgggccacttttgntaagcagaactggcgctgcgggatgaaccgaacgccgggttaaggcgcccgatgccgacgctcatctcccgcaaataaatgtattggtgatttgg

SEQ ID NO: 40668 - DNA, 151 bp, Homo sapiens
  misc_feature 6: n = A,T,C or G
cagacngtgttcccattgctctccatcctatttttctatctaaatgtgtcatgattttagaatctctttgtaaagaaaaccaaaaagagccatgcccaaaagaatgagcatgaaatgaagcaattcaagtatttagaatttcttcttcttt

SEQ ID NO: 40669 - DNA, 398 bp, Homo sapiens
  misc_feature 11, 33, 220: n = A,T,C or G
aactcaccagnaactgaagaaacagtgcaagcnctgagcttgttttccttcaactagatggtcccacctgggggtgatgtgagacagtaacagatcatcaggcattagattgtcataaagagcatgcaatctagacccctcccatgcacagttcacaatagggttcacactcctatgagaatctaatgccaccactgatctgatgggaggcggagcttangcagtaatgtgagtgatggggagcggctgtaaatacagatgaaggttcatttgctcacccactgctcacctcctgctgtgtagccccattcctaacaggccattgactggtaccagtctgtggcccaggggtttgagggtccctgccctagggcttcaatgcctacagaagcataaga

SEQ ID NO: 40670 - DNA, 433 bp, Homo sapiens
  misc_feature 8, 33, 34, 60: n = A,T,C or G
ggctctcnctcagacataattagattacgaatnnagacattaatagaagatgaaattgcnaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggtaagaaaattatggtttgctgaaaatgttagccttatataagtgttgccgttttgtaatg

SEQ ID NO: 40671 - DNA, 373 bp, Homo sapiens
gtctcctagtgtttccttttgctgtgctgtgtcccgtatatcctgtcatttccatttattttatcctcaaattataaagaattgtagtgttaagtccgttattcactttaagatgcagccagaacagtgactggagtggtttcatacctcatgggtttcccacacttccatcaacacacacttcacaacaccttggaggcattgtgaaaaggtcaagctttggagatggggaagagtcctgaagatgttgggtgacattgtacagtgaatggaggctgcctgcttggcacactttccatcacacatcacattttgctaatcttttggaataagggggaaagacatttaaatgagataattagagataagaatg

SEQ ID NO: 40672 - DNA, 129 bp, Homo sapiens
atggccgggaggaatgcgcttttttttgtacacatttttatccattttacattctaaagcagtgtaagttgtatattactgtttcttatgtacaaggaacaacaataaatcatatggaaatttatattt

SEQ ID NO: 40673 - DNA, 490 bp, Homo sapiens
  misc_feature 30, 33: n = A,T,C or G
ggaaatcaaaaaggggtggggggctgctgnttnttgctggaacacatccgaagggccttagaggggcctttgtgttttataatctgtctcacttgatcagagaaaaatatggaaatttgtgcaatgagaaaatatcctagtgtgaatacagacaggcatttcattgaaactatacaattatttacaactaacttgacaatcccaaatgaaaactgtctactacacaacagaaaaccattaaaacagtgctaacatcaatagagttccttttataaaaagaaaactaaattgaagttaccagcaggttacttttactttccacttggtttttccttttggttatattactgacaggcaccaaagtagctacagagaaacatacatgcagaaatccaattgccaagaaatcttttgcatctgaatcacttgggactctgtgtgcctgatcatactacaaacttctgaagttattctacaagcctcaaaatgc

SEQ ID NO: 40674 - DNA, 417 bp, Homo sapiens
  misc_feature 31, 33: n = A,T,C or G
gaggcactgaggcagccagcgcaggggcttntnctgagggggcaggcggagcttgaggaaaccgcagataagttttttttctctttgaaagatagagattaatacaactacttaaaaaatatagtcaataggttactaagatattgcttagcgttaagtttttaacgtaattttaatagcttaagattttaagagaaaatatgaggacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttg

SEQ ID NO: 40675 - DNA, 117 bp, Homo sapiens
  misc_feature 25, 113: n = A,T,C or G
tacgcacgcatgtgtcccaaatccngttttaattttttttttctgaatgtgatcatgttttggatgatacctgagcagggttgccttttttttatttattaccattatatatnatat

SEQ ID NO: 40676 - DNA, 127 bp, Homo sapiens
  misc_feature 8: n = A,T,C or G
atctgtcnaagttttgctttgttgatctgagtccttctatgaaagtttaaatatgtaacgcattcatgaatttccagtgttcagtaaatagcagctatgtgtgtgcaaaataaaagaatgatttcag

SEQ ID NO: 40677 - DNA, 485 bp, Homo sapiens
gaaatgcccaatttgggcggctcccccacctttctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgca

SEQ ID NO: 40678 - DNA, 342 bp, Homo sapiens
  misc_feature 7, 14, 33, 34: n = A,T,C or G
gataatnttgaatnaatgaaaagttttgattanncagtagttgtagatatgctaagtttttcaaattactaatatcaagtggagatgtttttacttttaagggtattgcttttgtgatagcataaatagtggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaactttt

SEQ ID NO: 40679 - DNA, 244 bp, Homo sapiens
  misc_feature 31: n = A,T,C or G
ctttgtcgatttttggaatcttatgagtaanagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaagggga

SEQ ID NO: 40680 - DNA, 401 bp, Homo sapiens
  misc_feature 30: n = A,T,C or G
cgtgcccgacctgtcgtctggtccctgttntcaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttct

SEQ ID NO: 40681 - DNA, 323 bp, Homo sapiens
  misc_feature 7, 31: n = A,T,C or G
gtttttnattatcggttttccttggaggggncagttctctatatttcaatctatttctctatatcagaaatgagcaggcattttaaaaaatggttttcattgatggagaggtaaaagtgaaatggctttgttgtatttatattataaaaggccatttcccaaatctagaatttattactaaaaatcaagtttgcattgaggggaggagtatgatttgctcaagcttactttttttataggtggggtttttatattttcaatgtgattactcacccatacaatttcagctctttcaaagcattcttgttggctattttcagagt

SEQ ID NO: 40682 - DNA, 446 bp, Homo sapiens
  misc_feature 23, 35: n = A,T,C or G
atacaccaatggaacagaacagnagccctcagtanataataccacacatccacaaccatctgatctttgacaaatctggcaaaaacaagaaatgggtaaaggattccctatttaataaatggtgctgggaaaactggctagccatatgtagaaagctgaaactggatcccttccttacacaatttttttcttttatatttattgcctgtgtcctaagaaacctttggctactcccatgtcatgatgatattgtcctgtgttttcttctagaagctttatctctttggtttttgtatttagttctattaatctggtcaaattaaaatccatttattgtatgagttgaagccaaatccaatttttacttatggatatctagttattgcagaactatttgctgaaagactcttttctcccattggattgcttgaacaatatatctaaat

SEQ ID NO: 40683 - DNA, 129 bp, Homo sapiens
acaaatactttctaattttctttagactttctctttgacatgtgggctatttagaagtgtattgttcagtttccaagcatgtggaaacatctggagatttgccagatttttctttttctttttttcttt

SEQ ID NO: 40684 - DNA, 224 bp, Homo sapiens
agagaccgagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaat

SEQ ID NO: 40685 - DNA, 489 bp, Homo sapiens
  misc_feature 35: n = A,T,C or G
caagaatccatattttaaaacgtctgtatgagttnaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgt

SEQ ID NO: 40686 - DNA, 410 bp, Homo sapiens
  misc_feature 30, 57: n = A,T,C or G
aacacactccgttgcaaacccaaagacccntttactttccaatctcagtcactctangactctgcactgaatggctgacctgacccgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagga

SEQ ID NO: 40687 - DNA, 213 bp, Homo sapiens
aggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtg

SEQ ID NO: 40688 - DNA, 386 bp, Homo sapiens
  misc_feature 20: n = A,T,C or G
accagactcgtctcaggccncctgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacga

SEQ ID NO: 40689 - DNA, 129 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaata

SEQ ID NO: 40690 - DNA, 107 bp, Homo sapiens
taaaaaagttccataaagcatcgccaaggcagcatgcctgtgcgacacacgcagggctttgggggtgtgttttccccgtattaacagcaagtcgttgaagcgttgag

SEQ ID NO: 40691 - DNA, 270 bp, Homo sapiens
  misc_feature 58: n = A,T,C or G
aacgtcaatttccttatctaaaatagtggtttgtttaaatgatgaagcaaagatggcnttggagctgttggctgactgtccctttttttctgctaactgcagaagcacggaatctgatgccctactttgtggggtaatggtgtgcttatctccccctcctcaaacagagtttggcacgttgctaataacagccagcctactgctaaaatatcaatgacagaacagaagaaatagatatttaggaaaacataaatcaaagctgaggaagta

SEQ ID NO: 40692 - DNA, 353 bp, Homo sapiens
  misc_feature 31: n = A,T,C or G
gggtaccccaaaccaattttaaaggatttgnaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaatgacacaggttaggagacgtcgctttgaacgtgctataggaccttctcaaacacacaccatcagaattcaatattcacctgccagactggcttatcaagacaaaggtgtccttcataatgaagttaaagtgagtatactgtggaga

SEQ ID NO: 40693 - DNA, 265 bp, Homo sapiens
ggttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccac

SEQ ID NO: 40694 - DNA, 405 bp, Homo sapiens
  misc_feature 44: n = A,T,C or G
atggaccgggatacccacctcattgcgaatgacagggcctattnactcaagcaggacttgcagagggacgagcagaaagatgcatctgactttgtggcttccctcctcccatttggaaataaaaggcaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggac

SEQ ID NO: 40695 - DNA, 391 bp, Homo sapiens
ctagcatttctatccgctaaactaagtcttcataagtgaaggagaaataaaatcctttacagacaagtaaatgctgagggattttgtcaccaccaggcctgccttacaagagctcctgaaagaagcactaaatatggaaaggaaaaaccagtatcagccactggaaaaacataccaaattgtaaagaccattgacactatgaagaaactgcatcaactaatgggcagaataaccagctagcatcataatgacaggatcaaatacacacataacaatattaaccttaaatttaaatgggctaaatgtcccaatttgaagacatagattggcaaattggataaacagttaagacccatcagtgtgttgtattcaggagacccatcccacgtgc

SEQ ID NO: 40696 - DNA, 325 bp, Homo sapiens
  misc_feature 7: n = A,T,C or G
gaagggntcagacacttgaaatttgctcagaaatagttgcattacacgcccagtgtgcaatggctgaaattcaggcacattcatgcttactgttctctgagatctgaacaaaatcaaattgcactgagcaaggatagtgctcaatcttttgttctttctgccaactaaaaattaaccagcggttgtttacttccctatataattctgtttaagagaatctggaccattgagacaccaggcttaaaatgttgtattaagatataaaagtaccttactttaaaaatagatttttattgatttatttcaaaattgttctgtcagttat

SEQ ID NO: 40697 - DNA, 334 bp, Homo sapiens
attttaaaaataggaatatgccttattgaaaaggcttcttagcaatgtgtcatgttcacctggaaggtttggtgtctcttagaattgaagggattttagaatcaatgaaatatactatctataccttgcttcatgcttctaacttctgtcaaattttgtggatatttagataattcaagagtaccagggtctacagtgtgtgcagctgtgcgtctttgctaatcaagtacaagaaagtcaaatattttaatgtttatattggaaagcttcatagaaatcaagttcccattgaataaaaggccaaaaaataaacaaaattatacttttaagaaat

SEQ ID NO: 40698 - DNA, 101 bp, Homo sapiens
  misc_feature 19: n = A,T,C or G
cttcccctggatgggaaancatctcaaggcctgaagctgcccagcaggcattccaaggcctgggtcctggtttctccggttacacaccctatgggtggctt

SEQ ID NO: 40699 - DNA, 194 bp, Homo sapiens
  misc_feature 2, 10: n = A,T,C or G
gnacacaggnatccggaagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaaattctttttcgtgaagaactc

SEQ ID NO: 40700 - DNA, 330 bp, Homo sapiens
  misc_feature 5, 9: n = A,T,C or G
cttcncagnactatcctatctaaaatatcatatcctctccccatccatccttggccgggcgcagtggcttatgcctgtaatcccagcactttgggaggccgaggtaggcggatcatctgaggtcaggagttcaagaccagcctggccaacatggtgaaaccccatctctactaaaaatacaaaaattagccaggcatggtgatgcacgactgtagtcccagctactcgggaggctgaagcagaggaattacttgaacctgggcggcagagttgcagtgagctgagatcgcaccactgcactccagcctgggcgaaagagtgagactctgt

SEQ ID NO: 40701 - DNA, 240 bp, Homo sapiens
  misc_feature 63: n = A,T,C or G
gcaggcaggaggagagtagaaaggagagacaattatgttcctgaggtctcagccttggatcangagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagc

SEQ ID NO: 40702 - DNA, 115 bp, Homo sapiens
  misc_feature 7: n = A,T,C or G
ctgctgngcacggtggcacatgcctgtagtcccagtcgctcaggaggctgaggtgggaggattgcttgaacccaggagtttgagcagagcctgagcaacatagcaagaagccatc

SEQ ID NO: 40703 - DNA, 240 bp, Homo sapiens
gaatttgtaatttaaaacttcacccccaagtaaatctttactccagatgatttcagtggagaattctatcaaacgtctaaagaattaacaccgattctacaaatctgatccagaaaatagaagagatgaagcatttcctaagtcattttatgaggcccatcttacccatatcaaaaccagacaaggaaaatacaaaaaagatgactacagaccaatgacctttaataagaacacagacac

SEQ ID NO: 40704 - DNA, 321 bp, Homo sapiens
cacgcccagctaattttgtacttttagtagagatggggtatctccatgttggtcaggctggtctcagactcctgacctcaggtgatcctcccgtcttggcctcccaaagtgctgggattacaggcgtgagccaccgcgcccagccttttctttttttttcctttttaaccacaattaaccagtactaatcagccagagtctagtcattccagataagtagaatgcttccttattttggcatgagttatctttcttatacaattttaaactctatccccaaaggaagatgtcaaactagagaatttcagttacattacaaac

SEQ ID NO: 40705 - DNA, 354 bp, Homo sapiens
gcatgtttggatttgcagtcttttgctttatgaaaagtgctgctgtaaaaattattattatctgtctcctgatgcatatgtgaaagggtttttctaggagtgaaattgctggataatatgtaaataataaacataagaaaatgtcaaattcttttccaaagtagttaatcaagttatactccaccagcagtgtataaggagttctcattgatccatatcttctccaacatttaggtttctcacagttttacatttttttgccagtgaaatgtacataaaatgtatcttatggtttaatctttgtttttttttaactcagtctttctgcttttattctttattctctattgaaga

SEQ ID NO: 40706 - DNA, 421 bp, Homo sapiens
catctatttgtgggcttctggcataaaatgcagctgtcccatatttgctttgtctgtttcccagacaaatcgtctcattgagcttcttccatctcctcgttgggcgccttagttttcccattttgaggctcctagtgagttcctttagtcttgcagtctccagctgccatagacatttttgcctcttcccaccatcactggctccaaagcctatttgcctcctcctccgactgcctatgtgagccttcctccgtctgactgcctttgtgagcctttcagtttaggaaccccccaatccccctgccctcaaagcttttgaatatcctcacaatttccttctttgaaaacattttcactccttccctcaaccccaaccccatgtggtcttctcaggccttttgtggaaatgatgatgaagaga

SEQ ID NO: 40707 - DNA, 500 bp, Homo sapiens
  misc_feature 27, 45, 47, 467: n = A,T,C or G
tatggaccgggaagggaacaacagggnaattaacttggcccagcntnactgtttgtggggctaacaccctgtgtatctcacaccaaccctaagctttgtttccctcctgtcactttactcctatttctttcatatgaaagaatgttcattttctttgaaaatgagctcatttcctcattttctttccatctttcagcaggaacaaagatcaccacaactggctccccttcaactatgttagatggcaacttgccttcagtatggtgaaacacatcagttaagactggggttgtgcatggcaggactttctacaaggacacccagtctccttaataaacatgagatgctctctttccagaagttctcttgcctgacacagcataggaagatgctgaacggccacacagtgacccattgagatagaatctcactatgttgaccaggctggtcttgaactcttggcaccnaagcgatccttttgcctggaatcccaaagtgtc

SEQ ID NO: 40708 - DNA, 248 bp, Homo sapiens
ctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttcc

SEQ ID NO: 40709 - DNA, 467 bp, Homo sapiens
gcagaccacccgtagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacatcgatttggacagctcaccaacccctgaaggggccgttcagcctggttagttttctacctactccgagtgtcctcccctgccccaccagattgctgcaggggcgcggtgtgcctggcagccaaattattgacacttcttttttcctatgcactggttttacacagctgtcatttttctttcaaaattgcagcagtcccacagatgtgtgcatttggacaaatagtacttaaaaacaaaacaagcactcagcccagctcctcaatactacctggaaaaagcattggcattatttt

SEQ ID NO: 40710 - DNA, 464 bp, Homo sapiens
tcccagcgtgctctgcgaggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttc

SEQ ID NO: 40711 - DNA, 418 bp, Homo sapiens
taagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtc

SEQ ID NO: 40712 - DNA, 132 bp, Homo sapiens
ggatgaatgaagctccatttgtaatcagcatgaagccaaataagtcatcagaatggcgcatgcttcattaagactgtgatcatatggcattttcataaggaagttacaagtcttaaaaggaccacaagtgac

SEQ ID NO: 40713 - DNA, 397 bp, Homo sapiens
  misc_feature 19: n = A,T,C or G
caagcacagtacgacaagnaaaccagggggaaagaaaaattaaggaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatg

SEQ ID NO: 40714 - DNA, 378 bp, Homo sapiens
catcgaagaaattggtgtatttttcaatttattcaggttattatttgtataaaaatgaaatttggttatttcttttcctataggaggcccatgattccatagatttcttctgattgggatcattgtaatacatgtttcgtttatcttcctgatttgaactgtatcttccttgagttctatcaatcgctcttcccttcattcaaatttttcataacattcttatatttatttgcatataaaagtttaaatttatttatattaagcatatgaataccttgaaaaatttcttgggggggaaccttttcttgcgggatatggaaaatattttcatgacatcaatttcctgaggtaaaaaaagttgaggtttgaagaggatgc

SEQ ID NO: 40715 - DNA, 442 bp, Homo sapiens
  misc_feature 7, 41: n = A,T,C or G
aagtganctggctgcactactctagcagaccccagcctagnatcagccatctcatatgataaatacattgcatattgttttatacactgagattttcagttgtttgttttgcagtaataacaaagtatacatctggcaaagtcaaaattagatgttggcaattatatggaggaaaaagaggttctctcattgacgctgatggggaagtaaattaataaaattcctttggagagtaatttgacaatatctaattgtaaagttgaagatgcccatatcctgtcagaaattccacctctaaatgcattcactagagaaacacacatataagcaaagaattatttaaaagatgttcattgcagcatgctagtagtgaaaaattttaaacaacctaagagtccaaaaggagaataatgatgaataaattatatggtagtcatcaatg

SEQ ID NO: 40716 - DNA, 158 bp, Homo sapiens
cgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgtctgtctgggcgtcgcttg

SEQ ID NO: 40717 - DNA, 133 bp, Homo sapiens
gcttcatccgccaactaatatttcactttacatccaaacatcactttggcttcgaagccgccgcctgatactggcattttgtagatgtggtttgactatttctgtatgtctccatctattgatgagggtccca

SEQ ID NO: 40718 - DNA, 416 bp, Homo sapiens
  misc_feature 33: n = A,T,C or G
atttgccgtgggctttctgtgggttagatgtanagcccacatattttaatattcactattttaaatgagcatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaagtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactg

SEQ ID NO: 40719 - DNA, 315 bp, Homo sapiens
gtcccctccaaagtaaaagacaaacttgcatcttgcatcctcaacagaaggaaggaagcacactatttggtgagcttctctgggtcctggcaacaccacattccacatctaagtatattgtttggcccactgtctgggtataatataggaagaggtcagctttgagtgcggactagacaggaagggacactgcagcagatccaggcggtggtgtaccaggtcatcaactctcagtcccctggtgctgggggtgacagcgtggggaaagatgctagatggagctgaaccaagcagctgagatcaagtgagctgaga

SEQ ID NO: 40720 - DNA, 265 bp, Homo sapiens
  misc_feature 23: n = A,T,C or G
gctctcttggtatacttcccagnaaattgagaaagtaaattattcaaattgctggagaacaaatctctttgctagtcaggtgcttcctagttcactgtttaaaagaaatgaagaaggactttatcaaattgtcatgtgcccgaagattaaaaatatttttgctaatagaccattacacaaatgttgacatataacatagaaggaattcaaagaactgaattacattgctataataaaacactctcaattccttcaacttacatct

SEQ ID NO: 40721 - DNA, 258 bp, Homo sapiens
gatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagcccg

SEQ ID NO: 40722 - DNA, 320 bp, Homo sapiens
tatggccgggagaaaaccaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtg

SEQ ID NO: 40723 - DNA, 490 bp, Homo sapiens
taagacaccatgagcaacttcctaaattcttgttacatagaaagtcaagtatttgttttcctctctgcattcttccttttgcaccattcctagtggcttctgtctttctgtgtcaaaaaaataaaaacaaaaatagaaaggatccattaaggagttttcccaataagaggtagtcctctttaggaagacttctttcattcttctaaaagaaagcagcactactcaataaaactttctgtgattatagaaatggtctctaatctttgctgttaaataaggcagccactaattatgtgtgactattatgagctttaaatatggctagtgcaactgaggaacattcagttaacttaattttaaactgaaatagccacacgtgactaccgagtatcatgttgaacagcacagttttagatgatctgcttcaaagtatagtcagctttttcttcctgttaaacatctattgcctttaattttttgaattaaaatg

SEQ ID NO: 40724 - DNA, 488 bp, Homo sapiens
gctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggtcaccagagtcaccaaccccaatgccaggctgcgcagtgaagaaaatgagtaggcagctcatgtgcacgttttctgttt

SEQ ID NO: 40725 - DNA, 163 bp, Homo sapiens
  misc_feature 11: n = A,T,C or G
tgcaacaaganttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatt

SEQ ID NO: 40726 - DNA, 350 bp, Homo sapiens
  misc_feature 4: n = A,T,C or G
gtcnacgaggagatcaacaaccggtacaatgggaagctcagctttggtattctgtgctgcacactccacgtttacccagaagatgtgtaattgcttctgagaagctgaggccaggagcagatacctctaacaagcgtgttctgagtgttctctatgagacctgggagctggaccaggttgtttcttagcgctacctccagctctccctcattgttcttcttttgatatagacatcgtgatttggaggaggaatgccttggcagccagagtggagcagttgaaaactgtgtatcataaaaatgaaaatgcattctcttaagtttgtgggcgcttgtgtcaaggcctgaaga

SEQ ID NO: 40727 - DNA, 252 bp, Homo sapiens
gggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttt

SEQ ID NO: 40728 - DNA, 349 bp, Homo sapiens
  misc_feature 32: n = A,T,C or G
ataccctggaatactatgcaaccataaaaaangatgaattaatgttctttgcagggacatggatgaagctggaaatcatccttctcagcaaactaacacaggaacagaaaaccaaacactgcatgttctcattcataagtgggagttgaacaatgagaacatatgggcacaaggaggggaacatcacacactggggcctgttgtggggcgaagggcaaaggggcgggatagcattaggagaaatacctaatgtagatgacaggttgatgggtgcagcaaaccaccatggcacatgtatacctatgtaataaacctgcacgttctgcacatgtatcccagaacttaaagt

SEQ ID NO: 40729 - DNA, 483 bp, Homo sapiens
  misc_feature 5, 6: n = A,T,C or G
aaatnnccagttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgggcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaaga

SEQ ID NO: 40730 - DNA, 462 bp, Homo sapiens
  misc_feature 30: n = A,T,C or G
gatcaacactatacaggaggatactccttnattcacgtaagagtgttgaccaaaggattactaaggacagactttgtcatcaaaagaaggacataaaggttaaatgtgagaggaaaaagtggggaagtctcatgatgaggttgggagtgactgcagaaacagccccataagacttctaagagaaaacagcaggtgcatcaacagaaaagggcaaggatgagactgaatcaaaacaaatacctgtatcatagcatgattttcacagccacaatacagagtaggagttaacaatattgagactgaagtctgaccctctaggtttaagaaggtcacctccctcattcagtgactatgtgaacttaggaaaattacttatcctctatattacttacatttaaaaactggggacaattatagcatttacctcattgattgctaagaggataacgaggaagagtttgt

SEQ ID NO: 40731 - DNA, 414 bp, Homo sapiens
aaagaaccttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaaaaagggggaaaatcataaatacaatgaatcaactgaccattacgtagtagacaatttctgtaatgtccccttctttctaggctctgttgctgtgtgaatccattagatttaca

SEQ ID NO: 40732 - DNA, 472 bp, Homo sapiens
  misc_feature 4, 6: n = A,T,C or G
agtnangcaaccacagaacaaaaataaagatgacagcagacatcttgttactgaatttaccaaaagagaatttagtgtaatatcattgttagagaactgaaagaaaatactgtcgacctagaattctatatccattccatatctggcaaaaatatctttcaaaaacgaaagcaaagtaaaggcattttcagatattcaaaagctgaaagaactcaccaccagcaaacctgcactacaaaaaatgctaaattcttcaggcagaaggaaaataataccaaacagaagcatggaccaacacaggaatacagagcactggaaatggtaacaacatagggcaattatataagatttcttattgattttctttaaaaggtaattaacagtttaaataaaaataacaatacattgtgggatttataacctatgttagaagtaaaatatatgataacactagaataaagctgagggggta

SEQ ID NO: 40733 - DNA, 160 bp, Homo sapiens
atttttggaatatagtgaaagacttaattcaaaggagatttattgaccaaaaagcttatttagaaaagaaaaaaggccagaatgttgggacctaagaatctaacttgagaagttagaatgagaggaacagattaaaccctgagaatggagaaagaaggaa

SEQ ID NO: 40734 - DNA, 238 bp, Homo sapiens
atttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaact

SEQ ID NO: 40735 - DNA, 426 bp, Homo sapiens
  misc_feature 63: n = A,T,C or G
attctatccattaatatcagtcatcctgcagttattcagttcaacaaatacttactatgaggntactatgtactggaatatatactctgctcttcaagagattacaatctagtgagggagaaggataggctttagactctttgtatgtatatatgactgagttcttgaaactcacatatcagaactgactccaactacagtttgtaggtcttagggatcttccactgaagcagactatttagaatttctcctccccaaatctgcatcctgtagtacacctcttatttcttttgtaaagtttgttggcagagcacagtgctcacacctataatcccagcactttgtgaggccgaggtggatggattacttgaggccaggattttgagaccagcctggccagaatttgtttggccagaatatggtctg

SEQ ID NO: 40736 - DNA, 488 bp, Homo sapiens
  misc_feature 2, 10, 33: n = A,T,C or G
gntctccagnaggcaataggcatatctaaagcnctgtgaagatgtccaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctag

SEQ ID NO: 40737 - DNA, 482 bp, Homo sapiens
  misc_feature 30, 31: n = A,T,C or G
ggctctctgggtagcagggtggtgtgatanntgcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccctatcaatttcaccatgttcctcaccatgtttggcgagaagttaaatggcacagatcctgaagatgtcatcagaaatgcctttgcttgctttgatgaagaagcaactggcaccatacaggaagattacttgagagagctgctgacaaccatgg

SEQ ID NO: 40738 - DNA, 438 bp, Homo sapiens
ctaacccactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaaga

SEQ ID NO: 40739 - DNA, 471 bp, Homo sapiens
  misc_feature 33, 34, 141, 150, 315, 348, 350, 414: n = A,T,C or G
gtaaaacaatctgatgtactgaagattcttaannattatgacagagaagccacagggaaaatcacctttgaagattttaatgaagttgtgacagactggatattggaaagagatccccatgaaggaatactcaaggcattnaaactattngatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggngacatttaaagaattacaaggataaacactcanantgttgcagttaccatcttatattctatttttgtgcctggagccatgtgaaaaaaaccaacttanttcttttatcctaaaggaccaaaaataagcatcttatatatctgtattttactactg

SEQ ID NO: 40740 - DNA, 381 bp, Homo sapiens
  misc_feature 28, 33, 34: n = A,T,C or G
ggcgcacttgtgccctggttcgccaagnatgtnnttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggatagggaaagaaaaacttatccagg

SEQ ID NO: 40741 - DNA, 321 bp, Homo sapiens
  misc_feature 8, 32, 33, 163, 303, 310: n = A,T,C or G
atagcacncacttcatcagatattagaattanntcacactattgaggttataatgctgaaggttgtgttacatagaaaccactttagattattatcaacttggactaggctttattttataatagcatagtaagtaatatctattgtgtcatttcttcacccntttttattctaagacccatgaagcttcttgaggccaaataaaataataagtttagacaagaagtagattgtgactttttttcccttagagatactattacttctcctcctatcctgataggtggaagggtttactgaatnggaaatnggggggactat

SEQ ID NO: 40742 - DNA, 258 bp, Homo sapiens
gaacacacggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtg

SEQ ID NO: 40743 - DNA, 391 bp, Homo sapiens
  misc_feature 32: n = A,T,C or G
tgatgacagatttgagagctcaaatcctttantgggccactgaaacttctctctagatttaaattcaattctgtaaacatatattcagtatttactttataatggactgtacttaattcagtgatgaacaggatatggtggtagtctcaagcacatcatcactctacagtgggagaaagacatccagaaataaccatggtataaaatattaagtataataacaaagttgtgaacaaggaacacaaaggagaggccagtaattatctgggagaagtgaatgatgcataccaaaatgagggatatttgagccaagttttgaaagagaaggagatgtttgtgagaagtacaagaaaagagtctgattgccattcattaatcagcatttattcat

SEQ ID NO: 40744 - DNA, 409 bp, Homo sapiens
  misc_feature 32, 58: n = A,T,C or G
gggggccttcctgaagctgacagcattcgggncgagatgtctcgctccgtggccttanctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatgga

SEQ ID NO: 40745 - DNA, 114 bp, Homo sapiens
  misc_feature 83: n = A,T,C or G
caggaggctgaggcagaattacttgaacccaggtaggcggaggttacagtgaacccacatcctgctattgcactccagcttangcgacagcagcaaaactctgtctcaaaaaag

SEQ ID NO: 40746 - DNA, 436 bp, Homo sapiens
  misc_feature 7, 31: n = A,T,C or G
gaactcngtggtggccctgcgcagaccatanttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtg

SEQ ID NO: 40747 - DNA, 276 bp, Homo sapiens
  misc_feature 32, 33: n = A,T,C or G
attgcacgccagataaacacttactgccgtannatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcg

SEQ ID NO: 40748 - DNA, 304 bp, Homo sapiens
  misc_feature 3, 52, 55, 56, 109, 111: n = A,T,C or G
agntttctaacaagctgacgctggaaaagctggacgttaaagggaagcgggnagnnatgagagtcgacttcaatgttcctatgaagaacaaccagataacaaacaaccngnggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccaga

SEQ ID NO: 40749 - DNA, 500 bp, Homo sapiens
  misc_feature 49, 74, 120, 177: n = A,T,C or G
gcagaggcttcatcaaggcactacccctaatgttaggtccttcttacanatcagcccacgtagtcctcacagcngctggttgaggagctattatcatcatccccacttggcagtggtacngtagaggctgaggctgagagagttgcccaggttcactctactggaaggagccagctntggaatctggaattcagccccaggcctctctcagtccaagtccagtgcgcactatctctttcatggactgcctcccattctcaggatcctaatgtctttatctaaccctgctggtggccagaagcctctacctggtacccgtcacaacccaggtgagaccaggcatctcaagatgcctcacctgacttccagctggaatccaacctgagctgtgcagttggctcaaagggtggccaaccagaggagcagatttatccacattggcatcagaaaaaccactctaggccgggcacagtggctcatgcctgtaaggctcatgcctt

SEQ ID NO: 40750 - DNA, 350 bp, Homo sapiens
  misc_feature 34: n = A,T,C or G
ggttgccggggacgctgctgtaagaggagtatanatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgact

SEQ ID NO: 40751 - DNA, 371 bp, Homo sapiens
  misc_feature 32: n = A,T,C or G
atggttctcatacaatgcaattattattcagnctaaaaatgaaagaagttccgatacatgttacaacttggatgaaccttcaaaacatgctaagtgaaagaagccagacatgacacatcacatattgtttgattccatttatatgaattgcccagaagagcaattccatagagacagaaagtagattattggtggccaggggctgggcagagagaggaatgggggatgactgctaatggaaacagtttcttttaagggtgataaaatattctagaattaagatactggtgatagttgtacaactgcgaatatactaaaaacactgaatttgacaatttaaaagggtgaatttcatggtgtgtgaattatat

SEQ ID NO: 40752 - DNA, 356 bp, Homo sapiens
  misc_feature 33, 77, 96, 207, 302, 334, 351: n = A,T,C or G
ctctactaaaaatacaaaaattagccgggcgtngtggcgggtgcctgtggtcccagctgcttgggaggctgaggcangagaattgtttgaacctangaggcggaggttgcagtgagctgggatggtgccattgtactccagcctgggagacaagagtaaaactccgtgtcaaaaagaaaaaaaaaaattacctgggcatggtatggnggcaggcgcctgtagtcctacctacttgggaggatgaggcagggagttgcttgaacccgggaggcggacatttcagtgagccgagattgcccaanatcgcaccactgccctccagcctgggcaacanagcgagactccgtctcngaaga

SEQ ID NO: 40753 - DNA, 151 bp, Homo sapiens
  misc_feature 19, 56, 72, 78: n = A,T,C or G
cctataattcttgtgctgntggatatcacccccatgatgggtgtcctggacggtgncctaatggaactgcancactgngcccttcccctcctgaaagatgtcatcgcaacagataaagaagacgttgccttcaaagacctggatgtggcca

SEQ ID NO: 40754 - DNA, 316 bp, Homo sapiens
  misc_feature 130: n = A,T,C or G
gaagaagcaagcagcgagtcttgaagctctgtttggtgctttggatccatttccatcggtccttacagccgctcgtcagactccagcagccaagatggtgaagcagatcgagagcaagactgcttttcangaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatg

SEQ ID NO: 40755 - DNA, 127 bp, Homo sapiens
  misc_feature 17, 33, 124: n = A,T,C or G
ggaagcggaaaactggnaagacagaagtacggnaaggcgaagaaaagtaatagagaagatagggaaattagaagataaaaacatacttttagaagaaaaaagataaatttaaacctgaaaagtngga

SEQ ID NO: 40756 - DNA, 371 bp, Homo sapiens
  misc_feature 366: n = A,T,C or G
gggaaaaagtatatatatacacacacacagtacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattangagtg

SEQ ID NO: 40757 - DNA, 248 bp, Homo sapiens
agtgttaagatggtaaatcttattaggtatattttgccacaattaagaaaaagaaattaataaaaatgtcaatagtaatatagtggaccacacaattagaacaaagaaatctcaattctacttctggcttgtctattaactagcagtatgagcttgaacaagtcaataattctttgtgtgtttagtgaaagaatctaaactgtatataatcttaaggccctatcttcatgttgtaacccccccctccc

SEQ ID NO: 40758 - DNA, 301 bp, Homo sapiens
  misc_feature 6, 72: n = A,T,C or G
gacgcnaaacaaattgcaatataatgtgataagttctttaaaagaggtaagagcaacgtgctttgggagcanagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttct

SEQ ID NO: 40759 - DNA, 116 bp, Homo sapiens
cgcagtgggtccacctgtgatcccagcacttcgggaggccaaggcaggcagatcacgagatcaggagtttgagaccagcctggccaacgtagtgaaaccctgtctctactaaaaat

SEQ ID NO: 40760 - DNA, 402 bp, Homo sapiens
  misc_feature 3: n = A,T,C or G
gtncaaatatttagctaattttgcttttaataactgtataaattgtaattatcatcttttaccactggatggtgcttttccattggttactgcaaaccctttctaaatttacctaagggcaccatttgaaaattcatttaaaaaacaaatgaaattaagataatggtatagtttcccatctcagcctgggcaacagagcaagactctatctcaaaataaagaaaaattgtccctggtaattattttgtcttttctcctatccagtagctgttcagactcctttcactgaagcccttttatttcacaaatactattttcaaattctgcttttttagctaccaaatgactttttgttagctaccctacttaaatgagttgagtacttaagtctatagagtctat

SEQ ID NO: 40761 - DNA, 276 bp, Homo sapiens
tatcagcaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttg

SEQ ID NO: 40762 - DNA, 213 bp, Homo sapiens
  misc_feature 116: n = A,T,C or G
gaagtgacggtggcgtttccttgaggaagagtgagggttccaacttttctgcttatctgggaggtgttgggcgcggacagtcgagatgtcagagaaaaaacagccggtaggcttangtctgttagaggaagacgacgagtttgaagagttccctgccgaagactgggctggcttagatgaagatgaagatgcacatgtctgggaggataattg

SEQ ID NO: 40763 - DNA, 470 bp, Homo sapiens
  misc_feature 6, 7: n = A,T,C or G
gcaaanncaaacaaaatctgctccatagtgaataacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttagga

SEQ ID NO: 40764 - DNA, 333 bp, Homo sapiens
  misc_feature 13: n = A,T,C or G
ggtggtcctgatnaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 40765 - DNA, 349 bp, Homo sapiens
tgaatgaagcctcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttga

SEQ ID NO: 40766 - DNA, 220 bp, Homo sapiens
  misc_feature 11, 18, 29, 34, 47, 95, 176, 192: n = A,T,C or G
gtgagaccgtntatgctnatctgggaggngttgngcgcggacagtcnagatgtcagagaaaaaacagccggtaggcttaggtctgttagaggaanacgacgagtttgaagagttccctgccgaagactgggctggcttagatgaagatgaagatgcacatgtctgggaggataatngggatgatgacaatgnagaggatgacttctctaatcacttacga

SEQ ID NO: 40767 - DNA, 467 bp, Homo sapiens
ggactctttcctgtcccggcctgcgtggtgtgggcttgtgggtctttgagacccgaaaattgagagcgttttcgcactccaggggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatggga

SEQ ID NO: 40768 - DNA, 353 bp, Homo sapiens
  misc_feature 77: n = A,T,C or G
aattttagtactttttaattatgcaaataaatcaatgtttccttaaattttgtcattgctttgtcacagttgtctanggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatg

SEQ ID NO: 40769 - DNA, 341 bp, Homo sapiens; identical to SEQ ID NO: 31110

SEQ ID NO: 40770 - DNA, 394 bp, Homo sapiens
ggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtac

SEQ ID NO: 40771 - DNA, 278 bp, Homo sapiens
  misc_feature 21: n = A,T,C or G
gcactgaagaggagagcgagnatagtagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgc

SEQ ID NO: 40772 - DNA, 356 bp, Homo sapiens
cagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaacgaaactcctattataaatttaagataatgtaatgtatttgaaagtgctttgtataaaaaagcacatgataaaaggaat

SEQ ID NO: 40773 - DNA, 260 bp, Homo sapiens
  misc_feature 26: n = A,T,C or G
ggagagagagactggagacgcacagnatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccg

SEQ ID NO: 40774 - DNA, 209 bp, Homo sapiens
ggcaaaaaataaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactgatgtcattattttgaaaaaataaatttaaaaatacattcaaaatt

SEQ ID NO: 40775 - DNA, 352 bp, Homo sapiens
ctattctattgacgaatgtttcacattttctcaaacgtttcgaggaaatataaaaatatgttgccccaacttcctttccaatttccaaaggaacattttggctgggaattaggaaaatttcgttctatgtataacatctacgaagatgtttaaactgtaattgcatgccatttcaaggaaatgttctttcagtacagtgaagactgacctactcgggaatattaaaatgtacaggggttcacattttggtgataatattttatcattttgaaaacttattcttaatacacccccacattacattttagtaaaatggtttcactttctttaacacccattaatagctattaga

SEQ ID NO: 40776 - DNA, 394 bp, Homo sapiens
agagtgacattttgcctcctaccaactgtcccaaccctaaacactcatatccatgagctggtttaataatttaagatggaaaaagcaaagggggtctaaaggactctgccagccaagaatccagaagcaagggctactagaattctgcagctgacagtggatggtgcaggtgcagaattgcatacgtctgcatgttatcactgccgcagaaatctcttacccttgctgcagaaatcagccctggagtgccccagaattccaagggcctgggtatgggccagtgtagctttggaaccaagtagtgaagattatctgaaggataatttttctagtcaaccaaatgtaagtacagagatttcctacccatctttttttgtggtcgtgatgtctgtga

SEQ ID NO: 40777 - DNA, 470 bp, Homo sapiens
catctcatcccagttaaaatggctttttatccaaaaagaggcaataaccaatgctagtgaggatgtagggaaaagtgaaccctgtacactcttggtgggaatgtaaattaatataaccactgtggagaacagtttagaagttcctcaaaaaactaaaaatagagctaaaactaaaaatatgatccagcaatcccactgctaggtatatacctaaaagaaaacaaattagtatatcaaaaaagtgtctacactctcatgtttcttgcagcactattcacaactaagatctgaaagcaacccaagtgtccatcaacagatgaacagataaagaaaatgtggtattaatacaatggagtactatttagacataaaaataaagagattctgtcatttgcagcaacagggatggaacctggaggtcattacgttaagtgaaataagccaggcacagaaagatgaactttacgtgt

SEQ ID NO: 40778 - DNA, 469 bp, Homo sapiens
  misc_feature 8, 116, 118, 145, 149, 196, 267: n = A,T,C or G
atcaccancattcctgcaaggtcttcctccttcccttacggaattacatcttgatggcaacaaaatcagcagagttgatgcagctagcctgaaaggactgaataatttggctaagncngggattgagtttcaacagcatctctgntgtngacaatggctctctggccaacatgcctcatctgagggagcttcactnggacaacaacaagcttaccagagtacctggtgggctggcagagcataagtacatccaggttgtctaccttnataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatt

SEQ ID NO: 40779 - DNA, 187 bp, Homo sapiens
ggcaatgcttttagattaaaatgaaggtgacttaaacagcttaaagtttagtttaaaagttgtaggtgattaaaataatttgaaggcgatcttttaaaaagagattaagccgaaggtgattaaaagaccttgaaatccatgacgcagggagaattgcgtcatttaaagcctagttaacgcatttact

SEQ ID NO: 40780 - DNA, 435 bp, Homo sapiens
  misc_feature 24, 27: n = A,T,C or G
ggctgatatgaatgtatcaacagnagnagtgaatataatgggatattatagtgaatggtaactttaaagaaaataaagtgattttcatacaaattattaatcttacatttcaacttttcaaaatgtatgtagacaaatttatttcattactttgcccctgaaaatgcctgtgaaatatctcataatccctgaggaccgtcttttgaagattctgagagaaaacaagaagggctaggactgagccatgagaaactctaaaagttacaagctgaggagaagtcaaagtgcaaaggagactgagaatttatggacaaaaaaataagatgatctggagagtgtcatgtcatagaaaccaagagaagagttattcaggacagaggataaactgtgaaatgttaccgtgagataagtaagatgaggactgaaaagagcata

SEQ ID NO: 40781 - DNA, 272 bp, Homo sapiens
  misc_feature 16: n = A,T,C or G
gggaaattcacaaagnatgtgaaaattaaacaacatactgctaaataaccagtgggtcaaagaagaaatcacaagggaaattagaaaatactttgagattaatgaaaatgaaaacacaacataccaacacttatgggatgcatatataacagtgtttatagagaaatccgtaacagtaaacacttattttttttaaacaagagatctcaaatcaagtctcacctttcatcttaagaaactagaagatgaccctagtaaatcaaagtaagcag

SEQ ID NO: 40782 - DNA, 207 bp, Homo sapiens
  misc_feature 34: n = A,T,C or G
aggggaagtgatttgcagagtggccagtacaggntcagtgggggcatagacacaggacatgtgacatatgtggttataagcagagaaaggaggcagcgagtgggagaagggtagcagccaccgcgcccagcccagtgagccatgattgcaccactgcactccagcctgggtgaccggagtgagaccctgtcaaagacaaaagcaaac

SEQ ID NO: 40783 - DNA, 481 bp, Homo sapiens
  misc_feature 60: n = A,T,C or G
atgattacagggacatctcaggctgactgtgctgtcctgattgttgctgctggtgttggngaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactg

SEQ ID NO: 40784 - DNA, 183 bp, Homo sapiens
cagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgcc

SEQ ID NO: 40785 - DNA, 472 bp, Homo sapiens
gaagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcatta

SEQ ID NO: 40786 - DNA, 358 bp, Homo sapiens
catgtcccttccctttactctgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttg

SEQ ID NO: 40787 - DNA, 194 bp, Homo sapiens
ggcgcaatagatatagtaccgcaagggaaagtatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagc

SEQ ID NO: 40788 - DNA, 490 bp, Homo sapiens
  misc_feature 33: n = A,T,C or G
aggcagggtctatgcccataacatcagcaggangcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacccctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcaccaactctgggcacactgcctataggttagccct

SEQ ID NO: 40789 - DNA, 361 bp, Homo sapiens
cggccggaaccgccatcttccgtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtg

SEQ ID NO: 40790 - DNA, 273 bp, Homo sapiens
  misc_feature 19: n = A,T,C or G
caagcaaaggcaaaccagnatctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaaccct

SEQ ID NO: 40791 - DNA, 387 bp, Homo sapiens
  misc_feature 55: n = A,T,C or G
tgcctttaatgtcttgaacattttaaattacttctattaccatgttgttttttanctagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacagtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttgaga

SEQ ID NO: 40792 - DNA, 227 bp, Homo sapiens
caaggcaaagtctgcctgtggctgcagcagtagctccttcccacttacccaaagctttgagctccaataaatcatctcaggaatacctggaaaatggaagagatgaggcgctctccctgtagaggggaagaaatgggagcacagaaaggacttggctcagagcctctttctaggaaaacatcaacttccttttgattttccaggcatcaaagaaaggtctatgcata

SEQ ID NO: 40793 - DNA, 377 bp, Homo sapiens
  misc_feature 24, 369: n = A,T,C or G
tatgatctacttgtataaatttancttctctatagctggcctattccccaaagaagtatacatggcttataaaatgcacaaaatacaatagaagaaaataaacataagtaagtaaaatcaggaacaggtaaaatataaatttgaatccaaggttaagactggagaaaagtagaatgcagacaggtatgtcctactgagttattaaagtcaagttgcaaatttggctctgggcttcctggaggctaaacagctagaaattaatggatagactaacagattttgatatgctatcagtgggaaaaatgtattttccattagccgtctaattctttaatacttcacactaaatatcctatgcagataaagttnaaatatgg

SEQ ID NO: 40794 - DNA, 462 bp, Homo sapiens
atatgagagtaacctataccacccttttcctcagagtaatctctagcctctcactgttagttcgcattctgaatctttaacccttccaaaaaggccaagcccagcccttggcactgtcccctatgacagagctgagctcctccatcaagctcagtggcagaacgatcctttcctcctttccaagatgactgcccagaatcacagaaacctgtaagaatggaaagagagtaatcccaattctgggcattcacccaaaagatttgaaatcagttggttgaagagatgtctggactcccaggttcactgcagcattagtcacaataaccaagttatggaattagtctgagtgtccatcaacagatgaatggataaagaaaaggtgggacatacacacaatggagtactatttggcctttaaaaagaaattctgttgttttcagcaacatgggtggaatttgaaga

SEQ ID NO: 40795 - DNA, 127 bp, Homo sapiens
  misc_feature 32: n = A,T,C or G
ggactatcaggatccggagacggaaatgtccnaaggccgcagtacttgaccctgtattttgggagtcgaacggagaatggaagctgaaagtggaaatcaggaaaaggtaatggaagaagaaagcact

SEQ ID NO: 40796 - DNA, 416 bp, Homo sapiens
gacaaccttagccaacctttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagaatcttagttcaactttaaatttgcccacagaaccctctaaatccccttgtaaatttaactgttagtccaaagaggaacagctctttggacac

SEQ ID NO: 40797 - DNA, 126 bp, Homo sapiens
  misc_feature 6: n = A,T,C or G
atctgnagaagttttgctttgttgatctgagccttctatgaaagtttaaatatgtaacgcattcatgaatttccagtgttcagtaaatagcagctatgtgtgtgcaaaataaaagaatgatttcag

SEQ ID NO: 40798 - DNA, 430 bp, Homo sapiens
  misc_feature 7, 27: n = A,T,C or G
aacgcancctggctcgtggtcccaagnaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtga

SEQ ID NO: 40799 - DNA, 121 bp, Homo sapiens
atatcaataaacacacagggctagggtcccaaactctcttgcatttgttcagaagcagtagggaacccttacttatgggcagtctccgatgtctttgccctcctgcagaagcaatcccttg

SEQ ID NO: 40800 - DNA, 396 bp, Homo sapiens
  misc_feature 14: n = A,T,C or G
gtatgtatataatntgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattg

SEQ ID NO: 40801 - DNA, 324 bp, Homo sapiens
attatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttcca

SEQ ID NO: 40802 - DNA, 244 bp, Homo sapiens
ggtgtgatcacagctcactgcatccttgacctccccaggctcaggagatcctctctgcttaggctcctgagtagctgggactacagggtgtgccatcacacccagctaatttttgtttttatttgtagagacagggttttgctatgttgcccaggctggccttgaactcctggggtcaggtgatccacccacctcagcctcacaaagtgctgggattacagacatgagccaccacaactggccg

SEQ ID NO: 40803 - DNA, 469 bp, Homo sapiens
ggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttattttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaat

SEQ ID NO: 40804 - DNA, 435 bp, Homo sapiens
  misc_feature 4: n = A,T,C or G
ggtnaaaacaaagaaacaaatagtccatcaactaaaataagctgtaatgaatttagaagatgaatgcatatattagatttccatttaaatcacttctgttataaatcatataaagagctttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaat

SEQ ID NO: 40805 - DNA, 209 bp, Homo sapiens
gcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactg

SEQ ID NO: 40806 - DNA, 427 bp, Homo sapiens
ggtaaacattcccgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcaggcaactaaatcccgaaatacaaaaagtaacacagtggacttcctattaagacttacttgcattgctggactagcaaaggaaaattgcactattgcacatcatattctattgtttactataaaaatcatgtgataacct

SEQ ID NO: 40807 - DNA, 202 bp, Homo sapiens
  misc_feature 7, 32: n = A,T,C or G
gcactancctatgagggtgagctggtcccctntatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgatt

SEQ ID NO: 40808 - DNA, 356 bp, Homo sapiens
agaaaaagtgctatgcagagaattagaatgaaatgtgctacagagtgagcaagggcgtctttcgattggatgatccaagaaggcctcttgaaggaggtgattttaagatgaattctgattggacacaaaggagtgagtgctgtggatgcactgcacaggttgcataagcatatagggccgctcttccaggtccccaaggcaagaatgagtgtgggcagcttcgaggagccaaaatgtggaacattgtggctgaggaacctgtggtgggaaattaggttacaaaggacagttaggacctgtcacctagttctgtggttcccaacctgggctttccattagaaatatcttgcaggaac

SEQ ID NO: 40809 - DNA, 268 bp, Homo sapiens
  misc_feature 9: n = A,T,C or G
tcacacagnagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaat

SEQ ID NO: 40810 - DNA, 469 bp, Homo sapiens
  misc_feature 8: n = A,T,C or G
gagatccnagcctcctaagaaatatccagaagtcaagccatggatccacctgcacgtaaagaaaaaaccaaagttaaagaatctgtcagcagagttgagaaggccaaacagaaatcagcccagcaggagctgaagcagagacaaagagcagagatctatgccctcaacagagtcatgacagaactggaacagcagcagtttgatgagttctgtaaacagatgcagcctcctggagaatgaggccccaggttcaaaccagatgggatcctgagagctttgagagggtgttgccagttttaagctgagatggcccatttggagccttacagaactagaccagaagacatttgtggataaatctgaactcacttcctgtgtgtaacttctaacttcactggttcctcccatctgaattggccacatgcttgctgaagagacttgttttcttcttctaagacagtgggttttg

SEQ ID NO: 40811 - DNA, 292 bp, Homo sapiens
gaagatgcagaggaccattgtcatccgccgagtactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattctc

SEQ ID NO: 40812 - DNA, 365 bp, Homo sapiens
  misc_feature 33, 73: n = A,T,C or G
gtctgatggaggcttcagtgtatacagatgttngacaactacaacatgaggggagaagggtgaagggacctanatggtagtgaggtttctacatgctacttgaaatggcaaaacattaatctaaattgactgtaagagtatgtgtatttggccgggcagggtggctcatgcctgtaatcccagcattttgggaggccaaggtgggtggatcacctaaagtcaggagttcgggactagcctgaccaacatggcaaaaccctgtctctattaaaaatacaaaattagccaggtgtggtggtgtatgcctgtaatcccagctactcgggaggctgaggcaggagaattgtttgaaatcgggaggcgga

SEQ ID NO: 40813 - DNA, 336 bp, Homo sapiens
ccggcggtgacgacctacgcacacgagtaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacatttt

SEQ ID NO: 40814 - DNA, 351 bp, Homo sapiens
  misc_feature 7, 31, 33, 58: n = A,T,C or G
gggtgcnttgttacattgaaattgttaactntnacagaaattggtgcatagaggtcangtgctgtcataataaaaatctaaaacatatactgttggctttggtgatgggagtgattggtagctaaagaggcagtgaaacaatgattagtagatactggaaagttaataaggaaatttctattggagggtggagaaagggccacccttgttatatagtggccaaagaatcagcaaaatgttgcctgctgcaacctggaaagtagaaacttttcttaaactcacggatctggctgggagatttccaggatgcatgcaacaaatgtgaatcaactttgtatagctgtgtataat

SEQ ID NO: 40815 - DNA, 187 bp, Homo sapiens
ggccatttaaaaccgccctcgctggagtgttcctgtttgtgaatagacccaccttaaccacccacttgcagcctatgtatccagctgcctggcagaaccctggtaatctgcaccagagctcagggacagcagaaagctgaagaccctttccccaaataacaagcctccttacccaagaaaccatcag

SEQ ID NO: 40816 - DNA, 292 bp, Homo sapiens
gggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgt

SEQ ID NO: 40817 - DNA, 320 bp, Homo sapiens
gacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttt

SEQ ID NO: 40818 - DNA, 469 bp, Homo sapiens
aagtgagttgagactctcaagctgttatttttttccttattctttgggttatttttactaatgtgtttttctgaaatcagtagctattattcctactgattgttattagtaaagtagtacgcactcaacatggtcaataaaacattagaaagtgtttattggcagccggtacagtggctcacacctgtaatcccaacaacaactttgggaggcaaaggtgggagggtcgcttgaacccaggagtttgagatcagcctgggcaagacagcaagaccccatctcttaaaaaaaatgttaattttcaaaatgtggttccacagcgttgatactgggaatatttactagacatgcaaattcttaggccccaccccaaaccagtgaaagcagaaactgggtgggcccagcaatctgtattaacaagcccttcaggtgattctgatgcacactactgttccagaagcactaattt

SEQ ID NO: 40819 - DNA, 168 bp, Homo sapiens
gtacgactcttagacggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatc

SEQ ID NO: 40820 - DNA, 260 bp, Homo sapiens
agtttaaaaaatagctaacagggcgggtgaatcacctgaggtcaggagtttgagaccagcctggccaacatggtgaaaccccatctctactaaaaatacaaaaaactagccaggcatggtggcgggcaactgtaatcccagctactcggggcgaggaggcaggagaatcacttgaacctgggaggcagaggttgcagtgagctgagatcgcgccattgcatccagcctgggcaacaagagtgaaactccatctcaacaac

SEQ ID NO: 40821 - DNA, 412 bp, Homo sapiens
agttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgat

SEQ ID NO: 40822 - DNA, 300 bp, Homo sapiens
gagggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccggtatgtacctttctgcatcttttatcttaacatatagggtgaccccaaacactgctttgaacttcctcaaaattctctctgttggg

SEQ ID NO: 40823 - DNA, 116 bp, Homo sapiens
  misc_feature 16: n = A,T,C or G
agaaataagaaggatnaatagatagctaattgcacagtacatatttgtatatataaaattaatagattttccaataagaataattgtgaaaaactgaccttattcataatgacagt

SEQ ID NO: 40824 - DNA, 470 bp, Homo sapiens
catgctgaagatttgcctattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttg

SEQ ID NO: 40825 - DNA, 105 bp, Homo sapiens
aacataaaaccctcattccacgagaaaacaccctcatgttcatacacctatcccccattctcctcctatccctcaaccccgacatcattaccgggttttcctctg

SEQ ID NO: 40826 - DNA, 371 bp, Homo sapiens
  misc_feature 146, 361: n = A,T,C or G
tccaatgaatgcatgcaaaaatttagtttctaagaatggttattgaattagaatggcaaagattagaaagaattaggtgtctgacaccagggagtggattagacacattttttttttacacccaaataaaataatataaagacagngaagaccaacaatatgagaaaattcttatagtattgtatgaagaaaacaggttttaaaatgatagcagtagtacaattccatttgtgtaaacaaaagtgtctgtggcagggtgtggagactcatgcctgtaatcccagaactttgggaggctgaggccgaaggatcacttgaggccaggaatttcagaccagcctgaaaaacatagcaagattgngtctctctat

SEQ ID NO: 40827 - DNA, 117 bp, Homo sapiens
  misc_feature 2, 14, 31, 51, 88: n = A,T,C or G
antggcccgggaanctgctgccctgctttantttttcctaaatactggganctgacttaccctaggaatgaagagggacaggaagtantctgaggatggagaactcagcaatagtag

SEQ ID NO: 40828 - DNA, 249 bp, Homo sapiens
  misc_feature 18, 21, 29: n = A,T,C or G
cagtgcagctttggttcntanttcagtcntctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatgcg

SEQ ID NO: 40829 - DNA, 467 bp, Homo sapiens
gagcaaaggaaaaatatgatccttttcgacgagcaaatgctgagagaattcatcaccattaggcctgccttgcaagagctcctgaagaaagcactaaatatgggaaggaaaaactgttaccagccagtacaaaaatacactgaagtacacagaccagtgacactatcaagcaaccacataagccaggaaaatagccagctagcatcatgatgacagtatcaaatttgcacataatattactaaccttaaatgtaaatgggctaagtgccttaattaaaaggcacagaatggcaagctgaataaagagtcaagactcatcagtatgctgtcttcaagagacccatctcatgtgcaaagacacacataggctcaaaataaagggatggaggaaaatttaccaagtgaatggaaaacagaaaaaagcaggagtcgcaatcctagtttctgacaaaacagagtttacacca

SEQ ID NO: 40830 - DNA, 251 bp, Homo sapiens
  misc_feature 1, 70: n = A,T,C or G
nagtctgtgaacttggggcattactcagtggatctggaaccttcttactctcaccagttggtttaggccntcccccttcctcttgaaaccaactttgtttgatatgtcattgtagattttctattatttcccccaaatcattccttaatgaacagttcaccttaaatgccttctctttgtatccagaaattatcagctcaaccaataaatagtatgtttgttagtcaagccagtgatccaggaaagacctg

SEQ ID NO: 40831 - DNA, 240 bp, Homo sapiens
atgacccaccaatacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgac

SEQ ID NO: 40832 - DNA, 153 bp, Homo sapiens
  misc_feature 4, 25, 29: n = A,T,C or G
tgantggtttgaggttgtagctctntaanagtagtttttaacctgcctgtagtattgctaactgcaaaaacatactctttgtacaagaagtgcttctaagaatttcattgacattaatgacgctgtatacaataaatgtgtagtttcttaatc

SEQ ID NO: 40833 - DNA, 315 bp, Homo sapiens
caggattaagcgattcctggccaagaaacaaaagcaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttga

SEQ ID NO: 40834 - DNA, 360 bp, Homo sapiens
  misc_feature 7, 43: n = A,T,C or G
ctcggancctaggtcgcggcgacatggccaaacgtaccaagangttgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtggc

SEQ ID NO: 40835 - DNA, 119 bp, Homo sapiens
aaaagtacaaaacattcataagagaaacctgcttacattttgatattaagaaataattccggggattcttccactcctgaaatgagttgatttgcagataactcacaacttcttaagct

SEQ ID NO: 40836 - DNA, 465 bp, Homo sapiens
agtgagagggcagaggaaacactcaatctgtgccctcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtata

SEQ ID NO: 40837 - DNA, 464 bp, Homo sapiens
accttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaagtggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctga

SEQ ID NO: 40838 - DNA, 477 bp, Homo sapiens
  misc_feature 28, 42, 51, 64, 82, 83, 85: n = A,T,C or G
cttggtttgaggcaggggaaagatgaanacttacttgcagcngtagttagngtagagagagaanacagatggctgtagttanngnacaagccgattgtaagcaagtttgcttctcaggggcattggttaaacaacttcttaactggccagggtccagcacgttaatcattaacctagggctgagcatctgctgcctgatgtatccagaattagtttatcattacctctaacgaccatcttttatggttccgaagagcctctatgcagtctcttatcaccgccatgcctaatcttcatttaccgggagcagtgtgctgatgtttcttagttagaccagagtaagaagtttatggtcagttgatgaatttttaattataactgtttaaaaagaagacgatgactatgaacagcagctcactcgtagcaatctttggacagtacttcgaagtgacccactttcccattttaactcttggg

SEQ ID NO: 40839 - DNA, 347 bp, Homo sapiens
  misc_feature 341: n = A,T,C or G
atggcaaaactggaagagtctacaatgttacccagcatgctgttggcattgttgtaaacaaacaagttaagggcaagattcttgccaagagaattaatgtgcgtattgggcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctntgggct

SEQ ID NO: 40840 - DNA, 269 bp, Homo sapiens
  misc_feature 2, 5, 227, 232, 269: n = A,T,C or G
tntanggcccgggggcgccttcatttacataaatattatactagcatttaccctctcacttctaggaatactagtattatcgctcacacctcatatcctccctactatgcctagaaggaataatactatcgctgttcattatagctactctcataaccctcaacacccactccctcttagccaatattgtgcctattgccatactagtctttgccgcctgcgaagcngcggngggcctagccctactagtctcaatctccaacacatan

SEQ ID NO: 40841 - DNA, 125 bp, Homo sapiens
  misc_feature 9, 13, 29: n = A,T,C or G
gattaaacntgtnaaccttttgcctaganttgcaaatctgttttttctccttccttttactactggtgttttacttttttggttatacagaagttgtatattgaaatataatcttgttctgtttt

SEQ ID NO: 40842 - DNA, 404 bp, Homo sapiens
gagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaaga

SEQ ID NO: 40843 - DNA, 305 bp, Homo sapiens
  misc_feature 21: n = A,T,C or G
caaataggaagaacgcacagngggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggca

SEQ ID NO: 40844 - DNA, 472 bp, Homo sapiens
  misc_feature 362, 461, 466, 469: n = A,T,C or G
atagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcactttgtgtgtggcacattgtagccccaaagaatcagcttatagaattaaagtttngagaagtttgatgtggagcgagataactactgccgatatgattatgtggctgtgtttaatggcgggggaagtcaacgatgctagaagaattggaaagtnttggnggngat

SEQ ID NO: 40845 - DNA, 298 bp, Homo sapiens
  misc_feature 256: n = A,T,C or G
gagaaacggaaccagcgggaaccttgacctgagacttgcagcctccagaactgggagaaaatagatttctgttgtttcaagcccccgagcctgtggtattttgtcccagcagcctgagcaggctgaaatggcccatttgttttattttacagggaggaaactgcagctgagtcagctcctctgactctaggccgaccgttcttccctgtatgacatgtgactcaccagataaagccacacacgtcattcttttttnaaaattctctactctgtcccaagttcttgtcccacattccag

SEQ ID NO: 40846 - DNA, 467 bp, Homo sapiens
taattcaaggacctgaagggatggctccacatgatttacttgcatatgatgcagctgtttttagtgctgcatttacatttttaaaaacaagaatgcaccttctcgatagaacagacatgcatttttaactcacaaactcaagaactgtagaaaaaggaagtttcttagaaattgggtccaaacacctttttgtactgaagaaaaagaaactttggtcccaaaagatttagtggcccttaactaagggtcagtcagtaatagaacaaagcaagggactagatggatttccagttcgaggctcttatttgtctcagatctaaaggtacaggtgtggtttatattgacaatttttcatgacatgcagctttttaaggcagtgatagatagcttagccgcttagctacttaaaacctctaacttctgtattagtttattatagcatatttatagtccctgtgactacctat

SEQ ID NO: 40847 - DNA, 316 bp, Homo sapiens
gaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggtgcagagattcttagaagaggaggtgtatcccctgttaaaaccatatgaaagcgtgatgaaggtgaaagcagaattatgtctgtagagttggaagagaattaaac

SEQ ID NO: 40848 - DNA, 309 bp, Homo sapiens
tattggtggaagttttaagtcccaaactgaagggaaggaggcctaggtggcacaatcagggaggaatatacatctgagaagttttgggaagacatcacctggcaaggctgcctgaaccacagtaatttggtcttcctctatccagatcactgagagttgtgtgctggtcttctctcaaaccctggatgtgttacctgcttctccctaagtgctctaacctcgctgaactatgagcctgaagggtgggtcgatgccagaccttaggtggaggccaaagacagtacagaataaacagcttcttcctaaatc

SEQ ID NO: 40849 - DNA, 465 bp, Homo sapiens
ctggaaacagccattgcgatgccatatgttggtcattggtgtccttaaagtgtatctcagataattgtgtgtctcccttacttgtgaactgaggggtcacaatattgatgtgcctgatgtgtgcccctctgcatttcgtgggtagtgtctcaaatttggctatcatattgatgagagttactaatttggttttagctgccagaggtttaggtggttttcactcccagtgacttacctgattgcacatagttacaacgttactggttgcactccttcattgctagcatcttttttctagtatattcgatatacattcttttggtttatcctttaaaatatttgctgagatagcatttaaatgttaatgctgtatttatattttgttggatgcttaattcaatgtgtcttctttccctttccatgaatgaaaagaaattggaagaagagaatcaactatttcgtgca

SEQ ID NO: 40850 - DNA, 154 bp, Homo sapiens
gttcttctatcaataccttattttaccttacagatatttgttgcacaggcagatactgctgtatttagacatttctatttcagttcattaaaaactgcaaaaccaatctgtatcatgtaccaaactgacttaaaataaatctacatgtttattg

SEQ ID NO: 40851 - DNA, 335 bp, Homo sapiens
  misc_feature 307, 327: n = A,T,C or G
caccatgttggccaggctgatcttgaactcctgacctcaagcagtctgcccggctttggcctcccaaagtgctgggattacaggcatgagccactgcgcctggccgttgttaaattttatctaactcattttgctgatcagttcactccactatattgtgtattccttttagtttttaagtcacaagtttgacaagcatgctatcatttggagtatttcagtttgtaatagaaatgttgaaacaaggggataaaactgtagtactacagttttactggaaggaaaatctcaaatggggaactaatgnccagaatgcagcagtgattntagaaaag

SEQ ID NO: 40852 - DNA, 203 bp, Homo sapiens
aaggacactgataaataaactgcaaagggtagagcaagcatagttagagaaaagaaaatgcaaggtagattagtacctacttgctttaagaggcccaaattaattaaagcctgttatactgaaataattttcactggaagatattctttgtgaaaccagagtagacaggagaaacagaaatggcccagtaggcaaatatatac

SEQ ID NO: 40853 - DNA, 434 bp, Homo sapiens; identical to SEQ ID NO: 38912

SEQ ID NO: 40854 - DNA, 127 bp, Homo sapiens
  misc_feature 25: n = A,T,C or G
cacaaccagttgtataacagaaatnctagctactgctttccttcctgtgtgtgaagtaatgaatcattgattctgtgacttgttatgtattcaattaaacactaaagaataaaacattcactcctac

SEQ ID NO: 40855 - DNA, 476 bp, Homo sapiens
gagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttaca

SEQ ID NO: 40856 - DNA, 473 bp, Homo sapiens
gaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaacccttcaaaattcttattattcctatttgtatatacacgagagaacccaaccagtgcctgtgtttgggggggaaaagtcaacagtgtagttctaaaccttatcccaaacagaaaatgtggttaatgatgtcactttccttgctggtcatcatt

SEQ ID NO: 40857 - DNA, 469 bp, Homo sapiens
gtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtggtcccagcactgtgggaggctgaggcaggaggatcatctgaggccaagagttcaagatcagcctgggcaacatagtgataccctatctcttaaaaaagaagaagtttttaaatttgaaataataataggtacctggatttatgcaaatgtcttttctgcgtcttttgagatgagtatcagggtttttttttccttttatcatctgatgatgaactt

SEQ ID NO: 40858 - DNA, 230 bp, Homo sapiens
cagctcacagtttcttgcctgaagcttggtgcgccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacag

SEQ ID NO: 40859 - DNA, 467 bp, Homo sapiens
  misc_feature 467: n = A,T,C or G
gattttcttaggctccacaattttggatgtcttgtaatgatatatgtcacctcactccactcagctggctctggcttttccctgattttttgtttgttaatgtcaatttttttatgaccttaactcccacaagtttttgaacttttgattattaatcgcagtgtgttagaattgtgtatcaatcaaccaatgcatctttcaggattagttaaatgattatgttacttaataagaagttttaattcatcgagtaatgtgaactatatgaggatatacatatattaattaatcagctattacctttagaaaacattcttgcatttctgagactaaaaatactcgctttcctattataggtccccttttgcccctccacattttcatatatgcgaaacatatactataattgaaaatgcaaaattagaccttaataagtattttttaagttccttataattagttaaatn

SEQ ID NO: 40860 - DNA, 498 bp, Homo sapiens
  misc_feature 3, 15: n = A,T,C or G
ccngggaattcggcnttatggccgagagagaggtccctcaggctttttctgggttgtttccatgaatgataaagtcattaaacaatttcataggcttgccttattgatctctcacaatggcatgctatgtctgctcttcaggaaagcctttcctgactgcccccatcagagttaattactacttactctgtgttcgcatggccttcttccatcttctattatagcattcatctcaggccaccttgccttacaattacttgtatctctttttcccactagattatgacctccttgaggacggggtgattttcttgttgctctttgtattatcctcagcatctaggtgaatctctgatacatcacaagggttcaataaatgctcattgaattgaattaactggatctgcattccaaggtcatctcttcctagactggtgttgaatgggattcccatgaagtgaggcagcagagtgcgtgcttgctggttctgttgctttg

SEQ ID NO: 40861 - DNA, 200 bp, Homo sapiens
aaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccct

SEQ ID NO: 40862 - DNA, 467 bp, Homo sapiens
  misc_feature 300: n = A,T,C or G
agagcatggtaacctgagatagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtntgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcg

SEQ ID NO: 40863 - DNA, 473 bp, Homo sapiens
  misc_feature 18, 470: n = A,T,C or G
ctattaagaagcattttnaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtggtttttaggttgattcnttt

SEQ ID NO: 40864 - DNA, 301 bp, Homo sapiens
gaattagaagaatcaaggccaggtgttgtggctgatgcttgtaatcccagcactctgggaggctgaggtgggaggactgcttgaggccaggagtttgaaactagcctgggcaatatagtgagaccccatctctacaaaaagttaaaaaattagctgggcatggtggtgtgtgcctgtatagttccagctactcaggaggctgaagtgggaggattccttgaactcagggatttgaggctgcagtgaactatgatcgtgccactgcactccagcctgggcaacagagctagaccccatctca

SEQ ID NO: 40865 - DNA, 471 bp, Homo sapiens
gttttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatc

SEQ ID NO: 40866 - DNA, 217 bp, Homo sapiens
caaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 40867 - DNA, 295 bp, Homo sapiens
  misc_feature 39: n = A,T,C or G
catgtgctatgtaaacgacacacctggtccaaccaaccnatcttttgggccccatgtaaatcaggcaccgccttctcaagcttgtctattaaaacctgtgcatttcatcacaaaactggaggacccgcttgggagcccctctctctctgcaggagagagagctattctctttcttttgcctattaaacttccactgttaaactcacttcttgtcctagatttctctggcatgagacaaccgaaccttaggtatttaccccagacaatgatgctgcttcaagaacaaccaaaaaat

SEQ ID NO: 40868 - DNA, 474 bp, Homo sapiens
agggaaatgggtcttagttggtcttggagaatgaaaggatttatatagacagaaattgagaggagaaacatttcaggcagaaagaataggcagaggactttaaaacggccaatagttcaggttctaaattaaaaaaagaagatgcatatgggatataagactgaaaaagtaggttgtgttcagatcatggaggccctttgactcttgcctaaggagtttgaactttatattgaaggcaatggaggaaccactgactgttttttagcacaataagttggtggattagagctttctttcaggaaagttaatctggctgcactgtttaggatgaatgggagcagggagagacattaaggaaattgtttcaagctagagataatgagggtctgctgaacgaaggcagcagaaatgaggaaggaagggggatgcatatggaaaagatattaagagatagaattgttaagagttaatgtt

SEQ ID NO: 40869 - DNA, 470 bp, Homo sapiens
  misc_feature 410: n = A,T,C or G
gtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgtttgaaggcagtaaactaaagggtgtcaagccccattccctctctactcttgacagcaggattggatgttgngtattggggggttatttttatttttcttcatttttgttctgaaattaaagtatgcaaaat

SEQ ID NO: 40870 - DNA, 467 bp, Homo sapiens
  misc_feature 28: n = A,T,C or G
ctcaacattcaggcaatactctcccccnctaaagattatgactcactaaaggttcaggtgattgttagcatctctgaataataaaatgtttttattttattttatttttttttgagagagagtcttgctttgttgcccaggctggagtgcagtggcggtgatcttggctcactgcaacctccgcctcctgtgttcaagtgattctcctgcctcagcctcccaagtagctggggttacaggcatgagccaccacgcctggctaatttttgtatttttagtagagacggagtttcaccatgttggccaggctggtctcaaactcctggtctcaggtgatctgcctgccagagcctcccaaagtgctgggattacaggcgtgagccaccgtgcctggccaatggagtgtttttaaattaaggcacgtaaagttttttaaaaaaatacaatgctacttcacatataataga

SEQ ID NO: 40871 - DNA, 474 bp, Homo sapiens
aatataggaaagttcttacagtagtgcctggatgtactatttactgtataagtattagctactactactattatttatataagagattgatccaagaaaaggcatccagaatgggcatcagagagagaagacagagtaggaaattgtactgggcatatgatatagaattctctggttgaggagatgaggtctgagaaatcatttacaatttaataaagttattggcctaagaatttgcttaatattcaatagcccaggtacagagcctcaagtaggttgttaattgaatagtccttgtggtagaaaaattggggcctgctatttcaagagtatttgtagactgtggtttgaatcaagtcctgttgggactgggcttattaataaacaaaaagattttgtagagccaaagtatatctttcattagcaaatgtaaaaaataccccaataccacatcaaaattagttgtacaagaga

SEQ ID NO: 40872 - DNA, 471 bp, Homo sapiens
ctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgagatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcata

SEQ ID NO: 40873 - DNA, 473 bp, Homo sapiens
  misc_feature 156: n = A,T,C or G
cttacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatngacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggca

SEQ ID NO: 40874 - DNA, 473 bp, Homo sapiens
  misc_feature 27: n = A,T,C or G
actgacagtttatgtaacattaatttnacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtggggatt

SEQ ID NO: 40875 - DNA, 272 bp, Homo sapiens
aaccaccaaacatattaactctaggctacagcggcatttgatctttatcctggtatgaaacatctctaaagatctcccattatcttagagatattttccaattctgacaaagtctcaaagttggcataaattgttaaagtactatacctttttttggaggttgaagaatattgttccctcctgtgcttccaaaaagttctggaaagttgtacctaggacttaaataaaatcttagttttccactgtcttttaaatttgagatgtatgcttac

SEQ ID NO: 40876 - DNA, 387 bp, Homo sapiens
  misc_feature 359: n = A,T,C or G
atttgttgaatctgaaatgatgttgccgccttgtataacaatggttatgtgactactgttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtacgtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaattnaataaatatactctagtatgatcagcct

SEQ ID NO: 40877 - DNA, 472 bp, Homo sapiens
  misc_feature 12, 86, 94: n = A,T,C or G
aatggacacagnagtaagcatttgacaaaatgtctaacaaccttttattctaaaatctctcaacatattggttgtaaagaggacantatagctngacaaaataagggtcacatatgacaaaccctcagctaacatcttattcagtggtgaaaagttgaaaactcttcctctgagatccaaacaagacaaggatgcccactatcaccacttctttcaacacagtactgaaagttctatccagagcaattagacaagaaaaagaagaaaaaaaatccaaatttgaagaaaacagaatttaaattgtccctctttgcagatgacatgatcttatatatagaaagccctaaagacttcaacaaaaaattattagaactaatgcataaatttcaggccaggcatgatggcttatgcttgtaatctcagcactttgggaggccaaagtaggaagatcacttgactccagtggtttgag

SEQ ID NO: 40878 - DNA, 469 bp, Homo sapiens
gcagttcggcggtcccgcgggtctgtctcttgcttcaacagtgtttggacggaacagacccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgaggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtgg

SEQ ID NO: 40879 - DNA, 500 bp, Homo sapiens
  misc_feature 4, 10, 42, 302, 400: n = A,T,C or G
cgangggaanctcggccactattggccgggggagcccgagantgtcactttatttaaaaagacaaataatcctctgacaagacagcactgttgcccttactaaggagaaatagattacaatccttattcctgtacacgttagctatgttccgtatggccacaggactttcctgaaaccgtatctgtctgcttgaagtagacttgtgtttgttgagaatgaacaggcttatttgagcctccagggtggcagttcataaagacagctaagttctgaaggaaaaaaaaaatatatctttttaagnggctagagtcattattacaatcttatactgtgaaagtccaagaaatcaggcaacattgtttcctgggtcttttcagagatcttatagatttatgaagngtttttaatccatgaagaaacactaaagtgcctttctttcttcaaagcaatattatttccaagtatattaatttgttagaaaactttcccataggaaatg

SEQ ID NO: 40880 - DNA, 171 bp, Homo sapiens
  misc_feature 2, 10, 30: n = A,T,C or G
tntattggcncgggggttttgtgaggattnagtgtttagcacagtgcttggcacatagtaagccctagtaaatgttaaatcttgttacttagtgtttcgtaaaacttgagaaatagagctgagctcattcccttcctgttgattcaaaaataatacctgcatgaaaacctg

SEQ ID NO: 40881 - DNA, 313 bp, Homo sapiens
  misc_feature 11, 17, 39, 41, 50, 51, 52, 56, 61, 75, 76, 85, 110, 148,202, 231: n = A,T,C or G
cccgggaaccncggccnctccggcccgggggaaccaccncntttgagacnnntgcnccacnagtactgtttttcnnacctggttntactggaagtaatggtacctttttncttctttcttgatagaaaccctgcttacactttaaccnaagcttctacttactgccctttttctaacacagactttctttcactgtctttcntttaaaaagaaattaatgctcttaagacnatatattttaacgtagtgctgacaggacccactctttcattgaaaggtgatgaaaatcaaataaagaatctcttcacatgag

SEQ ID NO: 40882 - DNA, 469 bp, Homo sapiens
  misc_feature 4, 12, 30: n = A,T,C or G
agtnccagtaantgctcacaaattgtacantgtggaacacagaaactgtgttaatactgtgggggcagaattaaaggaggcacgtaagtacttttagactagctagacagagaaggtagtggattctccctcactggaagcattcaagtagaaattagacaactacttggtaaggtcattggtgctgagggaaaggggaaaagtagaaggttaaagcgtggaagttgaatatgaattaaatgaactcttagcattcttctaacttaagaattccaggattctatatactaatgtccctaatgtgggaagtccatttttatttatttatttttagtacaattgaaaagttattgtcctcccctgccccagatctttaatacagaaatgtagatgatggtgtaaaatctttactaaaaaatatcagtctcttacgtggagtaatttcaacagagagatgtttcctaacatg

SEQ ID NO: 40883 - DNA, 354 bp, Homo sapiens
  misc_feature 3, 10: n = A,T,C or G
aanctcggcnattatggccggagaaaccttgtggaattgcctcagcagccagctaccccactgtgtgaagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 40884 - DNA, 217 bp, Homo sapiens
  misc_feature 24, 39, 43, 52, 58, 62, 77: n = A,T,C or G
actaggacagtgtcttctcagacnaccaccaaccttganggcnacaagtgantgaggnagangtctgttttgagtantagccagagaaaacaaggatggagaaaaatctaggacagtgtcttctgagaaaccatcaggcttgaagtgtcttctcggaaaaaaccagccttgaaggctacaagtgacgagaaagattctgttttgtatatagccagag

SEQ ID NO: 40885 - DNA, 416 bp, Homo sapiens
  misc_feature 16: n = A,T,C or G
cacagcactccaaatnattgacaacaccctcacacacacacagtctctagctgaacacatgccaacagagggagaagattggtcagtcatctgaagaagggatggcagcagcctcaagcaaaaatgccacagatggctgggcatggtggctcacgcctcttatttcagcactttgggaggccgcggcagatggatcacctgaggtcgggagttcaagaccagcctggccaacatggtggggccctgcctgtactaaagatgcaaaaatagctaggcattggtggtgcatgcctgtaattccagctaccttggaaggctgggacaggagaatcgcttgaatctgggaggcggaggttgcagtgagccgagatcgtgccattgcactccagcctgggcgacgagcagaactctgtctc

SEQ ID NO: 40886 - DNA, 484 bp, Homo sapiens
  misc_feature 15, 16, 47, 434: n = A,T,C or G
gtgctcagtaaaganncagcacacagcttaatactgacctactaaantggaactaaaggtagtgttgtgtacttccgcattcacttaatcctaaattaagagtatttactgatactcagttaaaacttcatcaaatattacaaaatctagtagggacaaaaatataaaatatgtttaagttgaaggaacactcagtgtgtaggaggtgattctttttactctgttaacactggaaatgataactttatttccttatctccccatcctccacatctactaacatatattacttccagcctttagagaagtaaatgtacttaaaaagataagtatagaggcctctgctgtattgcagtgtatgcattcttgaataatctcataaaccgcaaaacctatgcagctttgtattctgcacatgaacataaatgataaanttgggaggggatagccttgaaatgctcagtgaggcatcttagtagctagt

SEQ ID NO: 40887 - DNA, 180 bp, Homo sapiens
  misc_feature 2, 3, 29: n = A,T,C or G
cnntgttaattggtttgggagcctcctangtgtgacttactgacttctctgtgttctgtgtatttgtctgaattaatgacctgggatataaagctatgctagctttcaaacaggagatgcctttcagaaatttgtatattttgcaagttgccagaccaataaaatacctggttgaaatac

SEQ ID NO: 40888 - DNA, 499 bp, Homo sapiens
  misc_feature 6, 264, 456, 463, 467: n = A,T,C or G
tcggcnatctttggccgggataaagttttttttcccttgttgcttttttctacctatttctagctactccttcttcctctatttttttttctttcgtcctatctcttggaggctttatggaaaccctggagtcagcacacaggaaaactatattgacagagaataagcaaaacacaagatctccagagatacaacatacttcacccagggatcggccaactaattcccttttttctctgcagcacattcactgtggtcactgtngtttatatagctctataaaaatactgccctgtagaaattaagcacagaggcagcactacctcctcaccctactttataggatgttgggcctaaacatatctggtttagggtaagggcaggatttttgcctgaatcctccagacttgcagacacagtaagttccccatgcacctttcagagaccataggtagnaaggggnccgngattcagaatcacaaaactacataagcccttt

SEQ ID NO: 40889 - DNA, 473 bp, Homo sapiens
atttgttctgagtgagatggaaaggcattggaggctttcgagaagaggactgacgtgatttgacttgcatttgaaaagcatcactatggctaccatggggggaaacaaagtttaaaaggcaaagaagtactcagggacctccaaggatactcatacattcctgttaggaggcaataatatgggtgaaaaatgatggtggcaaggacaagggtgataccactacttacccattacccatcagaatagtcagaaagaaaaagacaaacaaggaaggaaagaaaagacagtattggcaaggatacaggccaattagaactttcctacactgctgttggtaaggtaaattgatatgaaacaaccactgtttagaaaaccgcagtatctactaaagttgaacatctgcctcctaggcatatgcctaacagaaacgtttacctatgttcactgaaagacatatacaagattagtcatag

SEQ ID NO: 40890 - DNA, 472 bp, Homo sapiens
  misc_feature 189: n = A,T,C or G
tctactgtgtctctagggttaagccaaaagacaaaaaaaattttactacttttgagattgccccaatgtacagaattatacaattctaacgcttaaatcatgtgaaagggttgctgctgtcagccttgcccactgtgacttcaaacccaaggaggaactcttgatcaagatgcccaaccctgtgatcangaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatcctttttgtatgggaaagactatatt

SEQ ID NO: 40891 - DNA, 449 bp, Homo sapiens
  misc_feature 448: n = A,T,C or G
aaagaaaatacagttttcttctaattcggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttgttattctttaggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatcctaanc

SEQ ID NO: 40892 - DNA, 281 bp, Homo sapiens
  misc_feature 281: n = A,T,C or G
aatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagctggcaggagtggggacagagggagagcttgtgactgggacagtgaaaataaacgattggctcttatcaatcacttgcgcan

SEQ ID NO: 40893 - DNA, 185 bp, Homo sapiens
tctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaacacat

SEQ ID NO: 40894 - DNA, 277 bp, Homo sapiens
  misc_feature 14, 19, 22: n = A,T,C or G
acaagatggtgccnccggngcnggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccacgagaattggcagaagatgacagcatattaaagtgagtgaccctgcgacccactctttggaccagcagcggatgaataaagcttcctgtgttgtgtt

SEQ ID NO: 40895 - DNA, 262 bp, Homo sapiens
  misc_feature 8: n = A,T,C or G
cgtcgttnaggtgtagaagggatagatgtagtttgctggggagcaggtgtcgtaggctgcatttctggactggtaaagatttccagtttttgaggaacaaatggtgtttcacttggagccagtgttgcccttggctgttcaagagttctagaagttttaggtgggatagaatccagaatacgatcacttgttgctgtgtaggaatctgatatctcaggctcatctgatgttgtagggcttgagaaaacatcataagttgctt

SEQ ID NO: 40896 - DNA, 240 bp, Homo sapiens
cactagagggggcataatatagcatgtgtttttatatttttaatacaaatatattttttaaaagcgctacaaaatattgttttatatatgtggtagccagcttccagatggccccagtgatccctggcctcctggtgttcatgccccagtatagccttctcctgcattttacagtgctgacttttgtaactaccaggatattgagcaaatgcagtgtgtgatttctgaggccatatcttt

SEQ ID NO: 40897 - DNA, 425 bp, Homo sapiens
  misc_feature 185: n = A,T,C or G
aagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattanctagtggagccactttctgtattgttacatggacatatgtagcaacacaagtcggaatagaatggaacctgtcccctgttggtaagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttc

SEQ ID NO: 40898 - DNA, 189 bp, Homo sapiens
  misc_feature 178: n = A,T,C or G
gaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgncaggggccaac

SEQ ID NO: 40899 - DNA, 369 bp, Homo sapiens
agcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttat

SEQ ID NO: 40900 - DNA, 315 bp, Homo sapiens
  misc_feature 2, 11: n = A,T,C or G
cnacgcttttnatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagaagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttt

SEQ ID NO: 40901 - DNA, 469 bp, Homo sapiens
  misc_feature 414: n = A,T,C or G
attggagtattaatatcctaggcagaaacatggaagtgaagacttctttctctgcaagggaaaccgatgatcccactcctgggaaatagtagggaaacttggtatgtgtatccccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacggtggtctcccacctatttgttccactgtctgccttcccctggttacttaaaattcatcagcttgtccaactggaccttctttccttcctgctgaagttnttttgaagtaaaaccttagattttgatgttaaaaacagttgtcaaatctgttggt

SEQ ID NO: 40902 - DNA, 488 bp, Homo sapiens
  misc_feature 48, 64, 68, 464: n = A,T,C or G
agcccacccgggcagccctcaccctgacaccttcgcagtaaacaagangaaaacaacttcttanaganaagcctgagcctgtaggtgtaaaagttggtgtccgaaccaggggctgtaatggcctttcttatactctagaatatacaaagacaaaaggagattctgatggaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtggngtttggattccagaagaaatgata

SEQ ID NO: 40903 - DNA, 385 bp, Homo sapiens
  misc_feature 4: n = A,T,C or G
attnaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagc

SEQ ID NO: 40904 - DNA, 470 bp, Homo sapiens
  misc_feature 34, 37, 72: n = A,T,C or G
tggatgaccttgagccctcaggtaacgagatggnggntctctggaggctgagtgccgtttgcggtgccctangaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactatttccctggctgcagccctcactcttcatggtcactggggccttggacaagttgttactgaatatgttcatggggatgccttgcagaaagctgccaaggcagggcttttggcactttcagctttaacctttgctgggctttgctatttcaactatcacgatgt

SEQ ID NO: 40905 - DNA, 407 bp, Homo sapiens
cagcttaggaagcccaaacaagcccccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatattttgcga

SEQ ID NO: 40906 - DNA, 135 bp, Homo sapiens
  misc_feature 2, 23, 26: n = A,T,C or G
angaaacataatggactcttaanaantggaaagggatgacatttacctatgtgtgctgcctcattcctggtgaagcaactgctacttgttctctatgcctctaaaatgatgctgatttctctgctaaaggcttac

SEQ ID NO: 40907 - DNA, 138 bp, Homo sapiens
ccgtggaaggaacagaaacaagcacttgggcgtgggttgtgactgcttttgggggagcctggggtttgggctcccacctgtttacagacctttttttctccttcagactttaaaattttaaaaatttaaaaaggaatt

SEQ ID NO: 40908 - DNA, 122 bp, Homo sapiens
  misc_feature 14: n = A,T,C or G
ccgggaattcggcnttacggccgggaactgcggtgatgatgtaaaaaccttcccataaaatgtaagaaaagctgatgaggctggcgacgttcagcctttgtcaataaacctgtcatgtgcgg

SEQ ID NO: 40909 - DNA, 468 bp, Homo sapiens
gataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttggagaatcatgttgaagctaaacccatatgcaaagaccatgcgccggaacaccattcttcgccaggccaggaatcacaagctccgggtggataaggcagctgctgcagcagcggcactacaagccaaatcagatgagaaggc

SEQ ID NO: 40910 - DNA, 228 bp, Homo sapiens
  misc_feature 18: n = A,T,C or G
ctattaggtaggtagatnacttgagaccggagttcaagaccagcctaggcaacatggcaaaaacccatctctgcaaaaaataacaaaaattagccaggcgtggtggcatgcgcctgtagtcccagttactcaggaggctgaggtaggacagtcgtctaagcctggggaggtcaaggctgcagtgagccactgcactacctcctaagcaacagagtgagaccctgtctc

SEQ ID NO: 40911 - DNA, 473 bp, Homo sapiens
  misc_feature 12, 20, 79: n = A,T,C or G
catttagacaanaataccgncagccttacttatgtgaagtgaaaacaggccaagctctagtttgtcctgtttgtaacgnagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaaggccaggattgatgacaaagtactcaacatcaaagaaaataaaacccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgat

SEQ ID NO: 40912 - DNA, 281 bp, Homo sapiens
agctggttccctccgagtttccctcaggatagctggcgctctcgcagaccctgtgaaattcataatggcccctaaggtaggggttgcctgacatgttcaacttggatttaacccttaaggcataagaagccgctgaaaatgttcagacgttacaaaactagggccgggcacggtggctcacggctgtaatcccagcacttcgggaggctgaggcggttggatcacctgaggtcagcagttcaagaccagcctgaccaacatggtgaagccccgtctctact

SEQ ID NO: 40913 - DNA, 337 bp, Homo sapiens
ccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgg

SEQ ID NO: 40914 - DNA, 440 bp, Homo sapiens
  misc_feature 205, 344: n = A,T,C or G
actctagtatatatctggtacttttgtcgggtgggtcattatttttgaatgccttcaccatcagactgcaatctgactctgagcaagaggaccagtttgcttctccggaatggtggacaacagataggatctgaactggcagcgtcagcatcccctgggagctggctagaaatgcagaatcccagccactacccccagagcaacncgattcatgcgtctgcctttcaacaagggcatccaatgttctggaccactgaccccctcctggggtataccagctacttcattgtggggagggggcttatgagaagctctacttaggattactattttaatataaaggnaaagtagcaaaatatgttaagctttacaaacatttattttattttattttttgagatagggtccagcctgggcgacacagcaagactccgcctcag

SEQ ID NO: 40915 - DNA, 470 bp, Homo sapiens
cgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctga

SEQ ID NO: 40916 - DNA, 340 bp, Homo sapiens
  misc_feature 37: n = A,T,C or G
aaggtaaagtgttgggggcctggggcttttgaaaatnttcaacttgccatgtgacttttccagggtgacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaact

SEQ ID NO: 40917 - DNA, 299 bp, Homo sapiens
tcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgt

SEQ ID NO: 40918 - DNA, 443 bp, Homo sapiens
agaaaccaggagtagctagagccttgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaaggaaggggaagttcctcttggaaaagatatagcaaccattggggaatgaccttttcatttcagaagtggatgaggaaggtggtgtgagcatcaggtatattctggaccatttcaagtgctggtgagaagaaaggaactctttgcctgaactgggcttgggtttccaagtgctgctttggaaatgaagacccagagatgcagagcttatggtagttcataaatcttcatgttctat

SEQ ID NO: 40919 - DNA, 143 bp, Homo sapiens
gagggggcagctggacaagctcccaactgcagagtcccagccctggctggggcggggccccggcctgggactcagcatttctgatatgccttaagaattcattctgttttgtacaattattttttaaaagtaaacgtgtgggg

SEQ ID NO: 40920 - DNA, 155 bp, Homo sapiens
  misc_feature 45: n = A,T,C or G
tacagcaaggtgttcttttgttcttaatgaagaaaggctaaatgnagcactgtaatttctatactaagtatttaatccctgtcatgatgtttttgttttgtaatttgcattatttgttaaactgggaatgcaataaaacaacttttgttgaaacg

SEQ ID NO: 40921 - DNA, 312 bp, Homo sapiens
  misc_feature 20: n = A,T,C or G
aatgataatacctgcccagnatactagttatggagattaaataagtgaaggcaattattatatgttctttaaattgtgtgtcactgtactgtgcatgtattaagtgtcgttttattagcaaatatctttttgatgggtagatgtttacctgaggtggttatttaatttataggctggcttgttcacactatgttatgtaatcattgtatattaatgaatatcactattttccttaggatatgatgtttagctaattcagccatgctaggcaaaagaggtcagcattgtagaaataagcaatgtcttatacca

SEQ ID NO: 40922 - DNA, 229 bp, Homo sapiens
atagtctatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgc

SEQ ID NO: 40923 - DNA, 452 bp, Homo sapiens
caccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttg

SEQ ID NO: 40924 - DNA, 438 bp, Homo sapiens
  misc_feature 40: n = A,T,C or G
gctttccaacttggacgctgcagaatggctcccgcaaagnaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaatt

SEQ ID NO: 40925 - DNA, 407 bp, Homo sapiens
atccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttg

SEQ ID NO: 40926 - DNA, 477 bp, Homo sapiens
  misc_feature 14: n = A,T,C or G
agaattctattagnataaatttgataaattgaaatagttaaaaagaatcaagcagaaatttgggagctgaaaaatacaattggcatattgaagaatgcatcagtgtcttttactagcagaattgatcaagcagaagaaagaaatagtgagcaagctattgaaaatagggcaggcagtttgaaagtacgtagaggagacaaaagaaaaaagaaataaaaaaacaatgaagaacacttacgggatctagaaaataggtggaaaaaagcaaatctaaaagttattggccttaaagaggaggtagagaaagatataggggtagaacatttattcaaagagataataacagagaattctcaaacctagaaaaagatagtaatgtccaagtacaagaagattatacaacaccaagcagatttaacccaaagaagaccacctcaaggaatttaataatccagctcccaagaaacaaggataaag

SEQ ID NO: 40927 - DNA, 137 bp, Homo sapiens
attgaaaacacttagtatgcagttgataagaggaatttggtataattatggtgggtgattattttttatactgtatgtgccaaagctttactactgtggaaagacaactgttttaataaaagatttacattccacga

SEQ ID NO: 40928 - DNA, 460 bp, Homo sapiens
  misc_feature 27: n = A,T,C or G
gccaagttcctgcatatggaatgtatngccaggcatggaaccagcaaggatttaatcagacacagtcttctgcaccatggatgggaccaaattatggagtgcaaccgcctcaagggcaaaatggcagcatgttgctcaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccacttt

SEQ ID NO: 40929 - DNA, 109 bp, Homo sapiens
atggtttctaaaataactagcagcatcatgaccatctgggattgtctggtccctgaagtcttggttgactgaaaccagattagttgtttttcctagacttacttttcag

SEQ ID NO: 40930 - DNA, 352 bp, Homo sapiens
aagtgagaagtagttagaactacagcagtggaatcttttgcctctttttcttagccatcacaccatggaataattgttgttcctgactccttcctttaggcaattgttgtcaagacattttgggccagggctgtaatctaggaccaggaaccatcagagtttatttaagaagaagtagagacatgcggcaacctaatagttgacagcagcaaatgaaacgagaagcacgtagagcccttaggtacaactggccttacctgacctagggtaacccttcttcccactcaacttcactaatgaactttgcaggcagtgtgatggctacttattattagatgctatgtccatttat

SEQ ID NO: 40931 - DNA, 168 bp, Homo sapiens
catggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatg

SEQ ID NO: 40932 - DNA, 160 bp, Homo sapiens
atcttctggcatgtctgtgtccttctcaaagtgtggccccaagtgataaatatttgaggtgatagatatgtaaattaccccaatttaatcattatgcattgtatgcatatatcaaaatatcactctgtattccataaatatgtacaattataacatgtgc

SEQ ID NO: 40933 - DNA, 236 bp, Homo sapiens
  misc_feature 46, 168: n = A,T,C or G
tcatcggatatacagcatattccatttaggatgtgtatttaatgcntttagtaatgacgataaagtgtttttagtatgcttttagtctcttgtaactggggagaagcagtgttttttttttaggaaaggattatgcgacacaataaaataagatattctgtctgtagngaatacatttctcatgtactaacactatttataatatatgattaaagatatttcttgttttattaaat

SEQ ID NO: 40934 - DNA, 148 bp, Homo sapiens
aaggagggatcaaattatgaagggctttttctgcatcattatgtagtatagttctggagttcaggactttatcttatacacaacatataaagtcaatggaggctttgaattttacatcaagttagcattttatgaagaatactttttt

SEQ ID NO: 40935 - DNA, 131 bp, Homo sapiens
  misc_feature 23: n = A,T,C or G
caggatcaagcgtgctttccttntcgaggagcagaaaatcgttgtgaaagtgttgaaggcacaagcacagagtcagaaagctaaataaaaaaatgaaacttttttgagtaataaaaatgaaaagacgctgc

SEQ ID NO: 40936 - DNA, 192 bp, Homo sapiens
  misc_feature 191, 192: n = A,T,C or G
gagacccgcctggcaacataccaaaaccccatctctgctaaaaatagaaaaattagctgggcgtggtgccacgtgcccatagtcccagctacttgggaggctgaggcaggagaatcacttgaacccaggaggcaggagattgccatgagccaacatcatgctattgtactccagagcgagactccatcgcnn

SEQ ID NO: 40937 - DNA, 167 bp, Homo sapiens
atctaccattttctggttcttgtgttggctgtggcaggccagctgtggttttcttttgccatgacaacttctaattgccatgtacggtatgttcaaagtcaaataactcctcattgtaaacaaactgtgtaactgcccaaagcagcacttataaatcagcctaacat

SEQ ID NO: 40938 - DNA, 482 bp, Homo sapiens
gactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatct

SEQ ID NO: 40939 - DNA, 193 bp, Homo sapiens
  misc_feature 190, 191, 193: n = A,T,C or G
gttctggggcaagagaactagatttcaggtattgattgtggtctttgttcagtttctggttaactaagtcagaaaccgttactgattcttccttaaatatgttttttcttaattaaaataaacatccttcattaaactaagaataactcttaaagaccatcaattctgagtaggctccagttgcaaagcnnan

SEQ ID NO: 40940 - DNA, 465 bp, Homo sapiens
actgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcactt

SEQ ID NO: 40941 - DNA, 102 bp, Homo sapiens
agtggctttggttccagcctgagcctgctgtgaagaatgattattattgttgccagttaactgctctctccatctgtgcatcaagtgtgggaaatatttgcg

SEQ ID NO: 40942 - DNA, 475 bp, Homo sapiens
  misc_feature 7: n = A,T,C or G
agatatnaagagaatccggaagaagaaaggcgtatggcatctgttttagccaaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcct

SEQ ID NO: 40943 - DNA, 202 bp, Homo sapiens
atgatttctccagctcgcgaggaaagagtcaacggtttgggattgtgggggagagagagacggagagaaaaaggcagcgcgaagcaaagaagggaaaatatcccaaggactaatctgatcgggtcttccttcatcaggaacgaatgcaggaatttgggaactgagctgtgcaagtgcttgaagaaggagatttgtttggagg

SEQ ID NO: 40944 - DNA, 463 bp, Homo sapiens
cagagctattcatcctcgtcatatttatctgagagatagtgagggtaggactgctctcattttgtgataatggaagtttagatacagggcaccaaaactggtacctatctgggacaggaatttgcacacctaatgcaagatcactctgttctgaggctagttttctttattgagtactttgtttataggataaggaaaggcaacactttaaggatgggagaaaatccagctcaaaggctgcagttcactccttggtttaatttcatctgtgtttatttgtctgcatattgcctttgagaccaatttcctttccactgtaaatttcccttagacctgcactgtccagtaaggtggcctcatgtaactaatttcactaaaatgaagtatgtttaaaaattccattgctatattgcattagccatattttaagtactcagtagtcatgtaggtaatgtatgataca

SEQ ID NO: 40945 - DNA, 388 bp, Homo sapiens
  misc_feature 384, 385, 387: n = A,T,C or G
aggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacannanc

SEQ ID NO: 40946 - DNA, 212 bp, Homo sapiens
  misc_feature 130, 135: n = A,T,C or G
gctggctttagctcagcggttacttcgacagttctttaattgaaacaagcaacctgtctgggttgttcgagacccgcgggcgctctccagtccttttaaaaaaaaaaaaaaaaaaaaaaaaacccactanaaaanaaaaaaaaaaaaaaaaaaaaaaaaaaaaaaaaaaaaaaaaaaaaaaaaaaaaaaaaaaaaaaaaaaaaaaaaaaaaa

SEQ ID NO: 40947 - DNA, 465 bp, Homo sapiens
gactacacttcctggcatggatcttacccgtgacaaaatgtgttccatggtcaaaaaatggcagacaatgattgaagctcacgttgatgtcaagactaccgatggctacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacg

SEQ ID NO: 40948 - DNA, 470 bp, Homo sapiens
ctccgtcgtggaagcaggactgcgccgcgtcttcctcaaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaaagccacacccaagatcacctgacacccgccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaactt

SEQ ID NO: 40949 - DNA, 464 bp, Homo sapiens
  misc_feature 26: n = A,T,C or G
agaagttaggggtttgtaagcatagnaggtgctatgggaatggatgacattgtgcagaaaattggtttaggttaagaaaagtggctattgacagaaacttggagagaggccatgtatgaggtaggaagatgaactagcagaagaccttattgcctttagagagatggaagaaaatgagtggatacaacattagggaagccagaggaggtgaggagtcattagcagtcttaaaagctacaaaaattaagtaggattaaggggccaaagcactgggaatatacagaaatgatggaaactttacaagaaaaatttcagtagatagaaaaatagcagctgagctagtggttttcacgtctttttggcagtaaaaggaaagaagataaagaaatggtactctgaggagctaatggagttgagggaattatgttgcaagtattatttgaaagcagtatttaaaacttttt

SEQ ID NO: 40950 - DNA, 272 bp, Homo sapiens
attgtaattgattttagaatccttgttagtcatcaaattttattattatttttttaaactccaggatttgtgttgtattcaggtagtttccccacccccgcttcctttcctgcctctggtttaattagagaatattcatggcccagaaaagtcaaattgaagccagagtattatagaatggtcagatatataagaaactgacatagacgtaaaaggaactacatactgttgctgggcgtggtggctcacgcctgtaatcccagcagcatccc

SEQ ID NO: 40951 - DNA, 370 bp, Homo sapiens
  misc_feature 368: n = A,T,C or G
ataaatcttagaattgaaactttgtttagccaagactaatttaaagaataattgcattaaatatatttgatcagatattccagttaaaccaggcgcggtaggtggctcactcctgtaatcccaacactttgggaggccgaggcaggtggatcacttgagcccaggagttcaagaccagcctgggcaacatggtgaaaccctgtctctacaaaaaacagctgggcactgtggcgcatgcctgaagtcccagctacttggaggactgaggcgggaggattgcttgagcccaagaggtcaaggccacagtgagccgtgtttgcaccactgcactcctgcctgggtgataaagcaagaccctgtctcaaaanga

SEQ ID NO: 40952 - DNA, 115 bp, Homo sapiens
gtgtttcagtaagcatccttacaacataagtctttgtgcccatgtacagctttatcattatgaagtcttaaaagtggaattgctggattaaagggtgcctgcattttcatcttct

SEQ ID NO: 40953 - DNA, 476 bp, Homo sapiens
taactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtt

SEQ ID NO: 40954 - DNA, 471 bp, Homo sapiens
aatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgcctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggca

SEQ ID NO: 40955 - DNA, 388 bp, Homo sapiens
  misc_feature 10: n = A,T,C or G
caataacagnaatagttaaataccacaggttctttgtgttttgctttagaaaatattgctcaaggctaagagtgagttctattgatgatttttatttgctgctgggatgcaaaacaatcagaattttcgaagagtttgcttcctttttgtgcatttcctttttttaaaaaaggaggggtctgtttcagatggaaaacattggtcgctaatagcagaaacttgagaataattggtaattttcaatcctgtagaaaactagactaggtctgatgactttgacctttgttacgctcttcttccaaattttccccagccagctccctgcactcctgaccctcagcagcccattccactgagggtcgggtaacctctggaacatcacagccga

SEQ ID NO: 40956 - DNA, 286 bp, Homo sapiens
  misc_feature 6: n = A,T,C or G
aatggnatcaaactaaaaatagtaaaggcacaggaaaatttctaaataacacatttataaataattcatacgtcagtctcaaaggaaaatattaaacataaaaatgaaaatatgttattaaatatgtgggatgtagcttaaaccagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagc

SEQ ID NO: 40957 - DNA, 479 bp, Homo sapiens
ggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcacttaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaat

SEQ ID NO: 40958 - DNA, 139 bp, Homo sapiens
acagtattctacgatgcaggctgaatgtatattacagtaattctctggctaattttaaaagtaagacatagaaaacaaaacacctgtagcattttctttatttaaaattgaaactctgttttgaatcctttttattttg

SEQ ID NO: 40959 - DNA, 333 bp, Homo sapiens
tatggaaaccatttttaatataattctgcacagacacagactgctggaggctacaccagagaagggaaggaaatagaacaatactcaattcattatgaaatttatttaaagtccctgctaacttggctctcactgatgccagaaggacagcatttaatttttaaagataccaaataaaaatgcatggttacaaaactttgtagttgtctagaatacattattttgaacatttattcttaagcctctttgataatgtgtaaaattatttaaaataagacttaaaaacaggtattgacattataatagcgttcatgctaatgaaagaatttctgc

SEQ ID NO: 40960 - DNA, 372 bp, Homo sapiens
tgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacgtgaatgtaaatgtgttatatggagacacgtcttgtaaacagttgaatgtatgtaagttttctgtttgtgaaaatgtagttaatgtactcactgtggaggtcataaggaagctactttttttttaaagtggaacctaattaaaatatttccag

SEQ ID NO: 40961 - DNA, 488 bp, Homo sapiens
ctgcagtggcttcgtcttcggtttttcttttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaact

SEQ ID NO: 40962 - DNA, 364 bp, Homo sapiens
tcagcaaatcacagtaaataccccccaatatcaacattcccgtttatactcttcagtaaatttttgtaaataaaattctgggattaaaagattattctgtgacagcttttcctgaatcttattcagtaaatcacatcctttggtttttatgctttaaaacaatttcttctgaaattaccaatatttacctttgaattggactcattgaaaatagctagaaggaatgtaagcttttaaagtctgcttttgctgcaccttggtttaagggaatgagtgagaaaataacacaacacttaaatgctattccagttctaattgttaggaaaaattatctaaaatgagccaagctcattgttctcatgtt

SEQ ID NO: 40963 - DNA, 410 bp, Homo sapiens
ctaaaccccttgtttacaaaagtgaagtgggtttcttcagctcaaggcaggagctttcctgcacctggtttaattctaagaagtcggggaaatgaagccaaataaggagtcacataaacaagccatttttgcaggaagtaatatgtgtctatctctatagcagttggggaggagatgactgcattgtgaaaaacctccagactgcctgtctgcattggctgttgagaagtaaaatgctaaactgtctcttaggtaaatctctgaatcacgaaaaagttgtcagtccagaactggaggcactctggccttctgcataaacctcctacaaatatcaggttctggacaaccagcacttcttcagagatgaataatcaaaaggaattcattaagcttgactgccacaaatgttt

SEQ ID NO: 40964 - DNA, 468 bp, Homo sapiens
cattttaattaattctgttaatgtttaaatagagttttaaacccgagatttggcatgaagtctaatcgtcaaatacacaaaaggaagggtccattcttcaaaatcttttccactgaaagaccacctctgatatacaagtctcgttgcattacagggatcctgcttccaagatgcagctttcacagcttgatgattgacccagaatctcctctaatgccatttttttacacccaaaatgagatttatttcagggcttccggattttattttagctgaatacatccactcttctgtttccatttctttcaaactcttttaaataattatcttgctgcatcagcccttatataactactgtccacccaccgagaccattacatttatccgtcaattaccctatttactaataatatatcaggattcaattaagtttttttgtcttaggttgtatcctcttgcattcctcag

SEQ ID NO: 40965 - DNA, 463 bp, Homo sapiens
atccacactgcccagtgccttgagcccagtcaagttcaggagatgggatgacaccaaaagagtggtctgggaactcggaggtatcaatatcacctgggagcttcttagatatgtagactctcaggccccacctttgacccacaaaggcagaacctgcattttagcaaggacctcaagtaattcatatgcactttaatgattgacaggcactgcttcaggcagtggtttagaacactgactgcatattggaataacctggacaatttctcataaatccaagtgctgtcacccacaccaaataaatcaaaatctcagctggggggaatcctgagattctaatctataccaccacatcggtgtgaaccaccaccgcacccagaacactctgacgccacagtcaatccatatgctgtcctagacgaatgcatttagctattcagctctgcgattaacatgtcgtctt

SEQ ID NO: 40966 - DNA, 307 bp, Homo sapiens
  misc_feature 43, 201, 219, 223, 263: n = A,T,C or G
atggcgcgggagttcccgtatatgagaaaaaaattgtacatantaactgtgaaaaaccaacacttattatttgtaaacatgttaagatactaaaaaacattatgttgatgattttcacatttaattatatatatatatatatatatatatactttaaagatagagggccttgctctggatcatagctcactgcagcctcanactcctgaggcaggagantggngtgaacccaggaggcggagcttgcagtgagcggagatcgngccactgccctccagcctgtgtgacagagcgagactcctttcca

SEQ ID NO: 40967 - DNA, 245 bp, Homo sapiens
  misc_feature 7, 32: n = A,T,C or G
gattatntgtgtactcattctcttacctagcnaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactatg

SEQ ID NO: 40968 - DNA, 297 bp, Homo sapiens
  misc_feature 4, 15: n = A,T,C or G
gagnagagagaaagnatagagaagaaagaagttccaggattctaatgtaccaaagggatctcctttttcttgttttgttctgaaaatttcaccaaaagagcacaggagaacatcttggctaattcattggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgcagggaaaggggaagttggaaaact

SEQ ID NO: 40969 - DNA, 242 bp, Homo sapiens
  misc_feature 241, 242: n = A,T,C or G
gtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagcnn

SEQ ID NO: 40970 - DNA, 465 bp, Homo sapiens
  misc_feature 7: n = A,T,C or G
gttgggnaagctcccagtaacttcgtaccctttgcacacaggggctacagcgcattttctacctgaaattggaagacttggtgccaccgccagcaataattgacaaacttttcctggacactttacctttctaagacctcctcccaagcacttcaaaggaactggaacgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataag

SEQ ID NO: 40971 - DNA, 450 bp, Homo sapiens
  misc_feature 378, 384, 422, 425, 429: n = A,T,C or G
gaagccttttaaatcccctctgaggtagcaagtatctatttgagaaaagaaataaaggtgcttcccttgtaaagaagcactttaatatttgcttttatgtatttatgcttcaaacaagaccaaaatattgatagtaatttttcctatgtttggaaacctgacctagattagcccaaattagtacaattactccttggtataattaccagattatactttgttgttgattaacccctccacttacatgtccatttgaaaaatgttttagcaatttaatatagcctctcacatgaagatacttttaggtattccattaggcttttcaaaggagcagttattattttagcttgtcctgttttttttttctacactattagngctatngatttccttcctatttttaagattatttcagaaattgnagngggnaatttctgtaatcccagcact

SEQ ID NO: 40972 - DNA, 337 bp, Homo sapiens
  misc_feature 33: n = A,T,C or G
tgttaaatgtggatcttttacaccacatcacantgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttc

SEQ ID NO: 40973 - DNA, 465 bp, Homo sapiens
gatttctgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacag

SEQ ID NO: 40974 - DNA, 490 bp, Homo sapiens
  misc_feature 31: n = A,T,C or G
caaagcctttgtggatcttggtataaagtcnttggaacatatctgttttaacagcaagagatcctaggcagatacttcaaaaggttaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttt

SEQ ID NO: 40975 - DNA, 448 bp, Homo sapiens
  misc_feature 7, 33: n = A,T,C or G
accactnaaaacacttttaaaaattttttaaanataaaaaatgttaaagaacatcatacaggaggtgaggaaagaatggagaagtgagcgcccagagacaggggcagggcagggagctgcttctctcccaacagcgcttgtctctccacactcacttgggctttccttccagtggcctcacagggaaatgggggcaagagttacaggtgggcaaagagttcttacacttggcaccaaaagcatgatccataaaaggaaaatttgatacactggacctcatcaaaatttcacatttttgctctgtaaaagatcctgttaacagaaagacaacattctaggagaaaatatctgcaaaccacatatccaacaaaggcctagtatctaaaatacatgaagagctcacaaaacttatggtaaaataacaaacaattcaactggaagataggcg

SEQ ID NO: 40976 - DNA, 402 bp, Homo sapiens
  misc_feature 400: n = A,T,C or G
cttgtctcaatgctcataacggatcagaaatacagattttgatagcaaagcgacgttagtcgtgagctctcgtgaggaaagtcattggctttatcctctttagagttagactgttggggtgggtataaaagatggggtctgtaaaatcttcctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagngc

SEQ ID NO: 40977 - DNA, 490 bp, Homo sapiens
aagcagcagccatgctccaaaccaccaccagtatctaaccaaactccaaactccaaactagttgaagtaaatccaaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaac

SEQ ID NO: 40978 - DNA, 179 bp, Homo sapiens
  misc_feature 6, 18, 22, 125: n = A,T,C or G
cttctntgtctttctttnaagnaattgaaaactcactcttttcacactaccttccctgacatcctaacttttaagcacatttttactggttcctctacttgatgggaatgtcatggtctgcttgnggaatgtgtccttgatgaaagtgttttggctctttaatctgtatgtaaatttcc

SEQ ID NO: 40979 - DNA, 237 bp, Homo sapiens
  misc_feature 29, 30: n = A,T,C or G
gatatctttgttttagatgctttaaaggnntcaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaac

SEQ ID NO: 40980 - DNA, 465 bp, Homo sapiens
  misc_feature 20: n = A,T,C or G
gttgctggctttagcagagnaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccctattcttcaactaaaagatgaggattaaga

SEQ ID NO: 40981 - DNA, 127 bp, Homo sapiens
  misc_feature 6: n = A,T,C or G
aggttnaaaaaaaatctaatgagtctgttgttcctttgcaaggcctagtgataggaacctcttcttggaaatatttgttaagccattctcacttgtagtcactcttggtaccaaatctgttgaccgt

SEQ ID NO: 40982 - DNA, 119 bp, Homo sapiens
  misc_feature 13: n = A,T,C or G
agacggacaagtnaactatgaagaattcgtacagatgatgactgcaaaacgaaggcctactttcaactcctttttcccccctctagaagaatcaaattgaatcttttacttacctctgg

SEQ ID NO: 40983 - DNA, 392 bp, Homo sapiens
tagagcattgctttttaattttaactttgttttataattatgtaaactatttacatggttccaaagtcaaatctacagaacaaaatgtattcagagtttatcttctgaccggttccctccaccctatttcctgcttctcttctgctgtaatcaaatttccccttttatccttccatttaagcaatataaacaaatgataaatgatagcatgctatttcacactttcctggacccttctattttgcttaaaatattggctgtcactccatagaaccatatagtatgttttccattgtaatgcttcattatgacagcataccattgtttattcgaccagtcactcctgattgacatttgggttgtttctagccctttgctattaaaaatattgc

SEQ ID NO: 40984 - DNA, 118 bp, Homo sapiens
ctgctgaaaatttgtctcgtttaagaggcagctagaatctttaccatatgtatgaatttgtataatttcatttttggatagggataaacttttgcttctgataaaagcctggaatttc

SEQ ID NO: 40985 - DNA, 184 bp, Homo sapiens
  misc_feature 12, 30, 32, 141: n = A,T,C or G
actggcctttgngattgcctctgaagcctntntatgccatggaggcactaacaaactctgaggtttccgaaatcagaagcgaaaaaatcagtgaataaaccatcatcttgccactaccccctcctgaagccacagcagggnttcaggttccaatcagaactgctggcaaggtgacatttccatg

SEQ ID NO: 40986 - DNA, 490 bp, Homo sapiens
  misc_feature 7, 28: n = A,T,C or G
aatatgnagaatgactcaatacccaagnaaaactcaaatacttctctgaaaactgtgagaatatacctttataaatgaagatattgcaaatttctggatggaaatgttttccaaattaatgtgttggtaatacattttgactcttaagtccaagtcagatagccagaaacttgttaatgtagttctaaagatgattggggaaaaaacatagtaatagctaggatgcttctaaaaaaaggaagtatcaatttaaattaagtacttgcatagccacatattcaagttttataaagctatggttattaaaatattacaatgctgatataaaaatcagtacagagaataaaaggcagtccaggaaataaaacccaatacggaggttcttaatcttttggaaagaagcagagctgtcacaaaatctttataaatcttgtaaaaactatggatctgtaaccgaggaaaatagtgtgcacacagtcacataaaattt

SEQ ID NO: 40987 - DNA, 316 bp, Homo sapiens
  misc_feature 32: n = A,T,C or G
aagtgccctgtggatcatcagtagtacccaantcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttca

SEQ ID NO: 40988 - DNA, 194 bp, Homo sapiens
tgagtaaaatgttaaaaataataagtgtaactcagattctggatgttcgagtttacaatacattgcctgtaataaaagctgattctgaagtgcatttttcttgacttactttggcagaaatatacttatatcttaatttatagtttgtaagtttatactgttttctaaaagtaataaatcatttcatgaaaaat

SEQ ID NO: 40989 - DNA, 465 bp, Homo sapiens
cttccttcttttttccggcgttcaagattttaagcgaggacgtggtaggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgt

SEQ ID NO: 40990 - DNA, 131 bp, Homo sapiens
  misc_feature 19, 27: n = A,T,C or G
agaagcaagtagaaacagnacccaagnaaatgtgctcaattgcaatgggccacatacctagcatctccagatgtcatttcccctctcttattttaagttatgttaagattactaaaacaataaaagctcct

SEQ ID NO: 40991 - DNA, 137 bp, Homo sapiens
  misc_feature 30: n = A,T,C or G
gctctaaatgtaaaatacactggattttanagacatggtagaaaaagaacagaaaatattttttgtattgattacatgttgaaacaatattttggctataatgggttaaatatactattaaagttgattttatctga

SEQ ID NO: 40992 - DNA, 115 bp, Homo sapiens
ctgacctagcatttatcaaggcctttcatgtggcagttaatgatatattgtcaaatattgttatctttttaaaatggtgttaggagcctgggtaacagagagaccccatctctac

SEQ ID NO: 40993 - DNA, 198 bp, Homo sapiens
  misc_feature 5, 31: n = A,T,C or G
tcttntggagatggcaagaaaggaggaaatnatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattg

SEQ ID NO: 40994 - DNA, 340 bp, Homo sapiens
  misc_feature 6, 20: n = A,T,C or G
agagcncaaaaattaatttnggcatcagtcctctatcttatattaacatattatcttattaagataaattttattaggaggctgtggcgggtggatcacctgaggtcaggagttcaagaccagcctgactaacatggtgaaaccccatctctgctaaaaatagaaaaattagccggacgtggtggcgtgtgcgtgtaatcccagctacttgggaggctgaggcaggagaatcgcttgaacctgggaggtggaggttgcggtgagccgagatcgtgccattgcgctccagcctgagcaacaagagtgaaactccatctcaaaaaaaaaaaatttttaatcg

SEQ ID NO: 40995 - DNA, 470 bp, Homo sapiens
  misc_feature 17, 47: n = A,T,C or G
tatggaccggggaaagnacctgatcttgcttcaaaaaatagaattancagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagc

SEQ ID NO: 40996 - DNA, 462 bp, Homo sapiens
  misc_feature 6, 31: n = A,T,C or G
cagganattctggatctcttttcttcagtantctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaattt

SEQ ID NO: 40997 - DNA, 468 bp, Homo sapiens
  misc_feature 13, 33: n = A,T,C or G
gtgccccgacagnattctcctatcggggtcacnttggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattaagcgcagagaccttcactgccctatcagtactaggtgtaatggtctatggaattaaaaaatatggtccctttgttgcagactttgctgataaactcaatgagcaaaaacttg

SEQ ID NO: 40998 - DNA, 472 bp, Homo sapiens
  misc_feature 34: n = A,T,C or G
agaaagccaagaaagcattatttcatcaagtccntagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattcca

SEQ ID NO: 40999 - DNA, 473 bp, Homo sapiens
  misc_feature 34: n = A,T,C or G
tacaatcgaatcctattaaaatctacataagctncccaattaccaaagaatgtctcttacatgaactataaacacgttttcaaagtacttagactatattctcatatgccaatcataaaaaagttactctttttcgtattccagaagagaaaagcaacctgctgaagccacagcagaaaaacataaattgtgaagatttcatggacatttgttagttccccaaattaatactttcataatttcttatgcctgtctttactgcaatctctgaacatgaattgtgaagatttcatgaacatttatcacttccccaatcaatactcttataatttcctatgcctgtctttaatcttttaattccgtcatctccgtaagctgaggatgtatatcgcctcaggaccctgtggtgattgcgttatctgcacaaattgtttgtaaagcatgtgtgtttgaacaatatgaaatctgagcac

SEQ ID NO: 41000 - DNA, 412 bp, Homo sapiens
  misc_feature 1, 10, 26, 27, 29, 30, 36, 39, 47: n = A,T,C or G
ncatttgtgnagctgacttgtacaanncnncctatnaanggcactanaaatacaagcaataaaataaaaaatgtaaattggacatgatcaacattttaaaacttttaaggccgggcatggtggctcatgcctgtaaatcctagcactttcggaggctgaggcaggcagatcacttgaggacaggagttcgagacaaccttggtcaacatggagaaacccgtctctactaaaagtacaaaaaattagccaagtgtggtggctcgcactttgtagtcccagctactaaggagactgagtcaggagaatcgcttggacgccagaggcgaaggttgcagtgaaccgcagactgcgtgccacttgcactctgccctgggcaacagagcaagacttggtctcaaaagaaaaacaccat

SEQ ID NO: 41001 - DNA, 192 bp, Homo sapiens
  misc_feature 7, 149, 157, 177: n = A,T,C or G
caggttntgcaaatgaatcaaagggtggtgaatatggaggattttactgagcagtggaagtcgctctcagctgaatgaagagctggaaatgggatggagtgggaaggtagtcttcccctgcagtttggccatcctggctgaactccttnctttccgnaggggtttttccctttaaanccctttttaaaattt

SEQ ID NO: 41002 - DNA, 475 bp, Homo sapiens
  misc_feature 2, 7, 29, 59, 130, 140, 180, 333, 365, 395, 434, 437: n = A,T,C or G
cncctantattttaaatatcacaaggacnttttagaatagtacctggctcaaaatattngagaaagagaaaaaggaagggattggatcaaactctggacttcatggtttcctgaattcactctgcaagtntttgggttgntttttgagacggaatctcactctgctgcccagactggagngcaatggtataatcttggctcactgcaacctccacctcccaggttcaagcaaatcccctgcctcagcctcctgagtagctgggattacaggcacgcgctggtacaccagttaatttttgtatttttagtaagagatggggtttcaccattgtnggccaggctggactcgaactcttgacctcggntccacccaccttggcctcccaaagtgctgngattacaggtgtgagccaccacacctggctgactctgcnagnatttaagtgaatgaatgtaagtccctgagaatcagaag

SEQ ID NO: 41003 - DNA, 475 bp, Homo sapiens
  misc_feature 7, 440: n = A,T,C or G
attgtgnagctagggaagaccaaccagttatgaaaaccaaattagtcacaacctatttaaatgcctatatttattcttagaagaaaatcacaccgctggatccaagagccaggagagtggtggagtaagggagcaacattcaatattaccactgagtttttactgcacatgccttcagtgctaggcagtagggctcataggatcaaagcacttctcacatgtagagagacaagtattcctgatctttagaactattttttctagtagtcatcttgtttaacatttagaattccaaacttggacagaaattttctcttaactatccacatttaaattatgttatacctttcagatgaatatacttggaattttcttaccaaaagttctgcattttaaatgaaattacccatatttgaatatgaatgtataattatccttgntggaaagacattaaaagccagcatttatttaaaag

SEQ ID NO: 41004 - DNA, 301 bp, Homo sapiens
aatcatcacacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgaggccccagctaaggttgaagccaaggaagagtcggaggagtcgggacgaggatatgggatttggtctctttgactaatcaccaaaaagcaaccaacttagccagttttatttgcaaaacaaggaaataaaggcttacttct

SEQ ID NO: 41005 - DNA, 500 bp, Homo sapiens
  misc_feature 24, 26: n = A,T,C or G
taacacttgctataaagctatagncntcaagacagtgtcatattggcaaagggatatgacacatagatcaatggagtagactagagtccaaaaatagacctacaacaaatatggtcaattgctttgatagaggtacaaagacaattcaatggagaaggagtcttttctacaatggtcttggaacaattggacatccaagggcaaatgaaacaaaacaaaacaaaaagctcaacctaaacttcatgtcttatacaaaaattgactcaaagtggatcacagatataagtgtaaaactataaagctttgataaaaacacataggagaaaatctttctgatctgaacttaggtaagttagacatgaccccaaaaagatgattcacaaaagaaaaatggatcacttagacacgtcaaaattagaaactattattctgtgaaagatactattatgagaatgaaaagataagctacataatgggagagaatacttaaaaatcacata

SEQ ID NO: 41006 - DNA, 485 bp, Homo sapiens
  misc_feature 4: n = A,T,C or G
accncttcatcgcatgaatagagaagatattctggcatttattaagtcttgcccacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggctattacaagtcagttgcatcaagtaaattctgatttacttggctggtggctttgtgaacgac

SEQ ID NO: 41007 - DNA, 157 bp, Homo sapiens
  misc_feature 25: n = A,T,C or G
gtaggcctttgtaaaattgacagancaggggaaaccccgtaaagtggttggttgcagttgtgtagtagttaaggactatggcaaggagtctcaggccaaggatgtcattgaagagtatttcaaatgcaagaaatgaagaaataaatctttggctcac

SEQ ID NO: 41008 - DNA, 124 bp, Homo sapiens
cattttctgaatattgataaagatatttagatgtagcagaaataatagctcctgtctatagagctgggggcggtgctaacacacaatgatacagctaaatgacaatccatgagaaaaacgagcc

SEQ ID NO: 41009 - DNA, 467 bp, Homo sapiens
  misc_feature 30, 147: n = A,T,C or G
tgcccggcacacccaaaataatgtaccttnttttcacctcaggaaactggttagtgtggtacatgtttggattttagtatagtggctaagccaaagctctgttagtaaattcctacaggagctcattggcaacttggtgcatgacangaaagagcaagactttgagccaaacagacctgggctcaaattccagctcaactacatagcagccttgtgaacttcacctctgcctcagcatcctcatctataaaattggtgatagtggcagagatttcacaggcttgttgggaggattaaaggaaatattacctactatggagcttctcgaagggaagcaattttgactttgtttttacttctttgttcaaactctcacttcagtcccaaaatgattgagttggcagcttagatattattacaggtggtttgccctacttcatgtcttttttaaacattggagcatctga

SEQ ID NO: 41010 - DNA, 467 bp, Homo sapiens
  misc_feature 33: n = A,T,C or G
gatccccgatgcgtttcctggcagctacatttntgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtg

SEQ ID NO: 41011 - DNA, 213 bp, Homo sapiens
  misc_feature 21: n = A,T,C or G
agtctcagtggagacaatagnaatcagtgatgtagtgagtagcttgagaatgcaagggaaaaaagagattaaaatggggtggggtggaaattatctttgttgacaaaaggaggtaaggattcagcctaagaacagtaagtgtacccaagcaagaaagcaggataattgaaacagataagtgtgttataaataaatacataacaaatatataac

SEQ ID NO: 41012 - DNA, 472 bp, Homo sapiens
agatatctcccatcaaatttcaaatatacacatgagaattatccacattgaaggttattagtgcattccagggacatttccatgttgattcacaactacccctttaccttacactttcctgtgttactagacgtctctttctgtaaaactcctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaac

SEQ ID NO: 41013 - DNA, 336 bp, Homo sapiens
  misc_feature 334: n = A,T,C or G
aatatattgctggattcaatttactaataaattgggtccatgttcttgagggcgattgatctgtgtgatctgtggttactttatattgtctttgtctagttctgatgttctggtaatgcttgtaacattgaggtgagaaatgtgtcttgtccaccccttcaaccccaaagacacacacattgtgtaaattagccaggcgtgttggcgcatgcctgtaatcccagctactcgggaggccgaggcgggagggtcgcgtgagcccgggaggcagaggttgcggtgagccaaggttgcaccattgcactccagcctgggcaagaagaatgaaactcgntc

SEQ ID NO: 41014 - DNA, 142 bp, Homo sapiens
  misc_feature 56, 104, 129: n = A,T,C or G
gacattcgcttctgacacaactgtgttcactatcaacctcaaacagacaccatggngcacctgactcctgaggagaagtctgccgttactgccctgtggggcanggtgaacgtggatgaagttggtggngaggccctgggca

SEQ ID NO: 41015 - DNA, 471 bp, Homo sapiens
  misc_feature 33, 60: n = A,T,C or G
gtcttccccttgtgactttttaaatattctgtnttggacattgtagttgaaattgtattngcaaaaagaatttgaggtctagtaataggtttctcattattgtttaatttgccttagagcaaattaaacaattttcatattcttatattttcatattcttatcagccgtcttttaaaaagtgcctggtcaaggatagtgaccatttaaaagttgatttgtttaactttttattattgatttgtgggagttcatcatatatcttttgtcatatacaagggggcttccaaaagttcacagaaaaatggaattaaaagataaaagtaagaagtatatggctggccatggtagctcacacctgtaatcccagcacttagggaggctgaggcaggtggattgattgagtccaggagttcaagaccagcctttgcaatatggcaaaacctcatctctacaaaaaatataaaaattag

SEQ ID NO: 41016 - DNA, 467 bp, Homo sapiens
  misc_feature 1, 10, 27, 28: n = A,T,C or G
naaatttatnagttatacagaattgtnntactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaggtcaatctagattta

SEQ ID NO: 41017 - DNA, 147 bp, Homo sapiens
gaagcactgtcagggacaggggagaggtcaaggaaggccttgttgaaaagtagtcactggatcaagcaacaaggggcattgttgaccccatgagagagttgactgggataatgcacatgatatccagattgaattaagatcagaacc

SEQ ID NO: 41018 - DNA, 112 bp, Homo sapiens
gctactcaggaggctgaggcacgagaattgcttgggcctggaaggcggaggttgcagtgagctaagaccgtgccactgcatgccagcctgggcgacaaagtgaaactgtccc

SEQ ID NO: 41019 - DNA, 482 bp, Homo sapiens
  misc_feature 2, 459, 471: n = A,T,C or G
gnatcacgattttcttccttttaaggttgatattattctgtagtacatatagaccacattttgtttacccattcattcatccatggacgcttgggttgcttccactgttttagctattgtgagtaatgctgctgtgaacatagtgtacaaatatctcttttgagactctgcttttattttattttttgcatatatacacagaagtggaattgctggatcacatggtaattctgtttttgattttttactgccatactgttttccacactagctataccactttatgtgcctacaaactgtgcacaagggttccaatttctccacatccttgccaacacttgctggttattttttttaatagtagccatcttaatgggtttgatgtggtatctaattctggtattgatttgcatttccctaatgattagtgatatcaagcatcttttcatatggttttgnatttgccttggntttaaatctac

SEQ ID NO: 41020 - DNA, 116 bp, Homo sapiens
  misc_feature 22, 34: n = A,T,C or G
aacgtacaaataaaatgacagnttgaacatactnaacccaccccattcctccccacactcatcacccttaccacgctactcctacctatctccccttttatactaataatcttatg

SEQ ID NO: 41021 - DNA, 266 bp, Homo sapiens
  misc_feature 32, 34: n = A,T,C or G
aagtaacggcagaaaagattatatgtcatacntncattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcg

SEQ ID NO: 41022 - DNA, 357 bp, Homo sapiens
  misc_feature 32: n = A,T,C or G
ataaggcagaagcttcagaaagttccgagganttgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcaggcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaat

SEQ ID NO: 41023 - DNA, 311 bp, Homo sapiens
  misc_feature 14, 27, 33, 35: n = A,T,C or G
gactgccctgaagnagggagagcgagnagagantntggagacgcacagatccccccaaggtctcccaagcctaccgtcccacagattattgtacagagccccaaaaatcgaaacagaggaaacgaacagtagttgaacatggacgaaggaattcctcatttgcaagagagacagttactggaacatagagattttataggactggactactcctctttgtatatgtgtaaacccaaaaggagcatgaaacgagacgacaccaaggatacctacaaattaccgcacagattaatagaaaagaaaagaagaga

SEQ ID NO: 41024 - DNA, 327 bp, Homo sapiens
aaaatgcaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagggttatgatcatagctactacttcattgcaacctttattactgaccacatcagacatcatgctaaatacctgaatgcatgaaaaaactccaaataagagaatctcttcaggattataaaagttgtaaaatgcaacctgtattgctgagt

SEQ ID NO: 41025 - DNA, 203 bp, Homo sapiens
cgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgat

SEQ ID NO: 41026 - DNA, 214 bp, Homo sapiens
ggccgcggtggcgcgtgtctgtagtcctccttggcttcccaatgtcctgggattacaggtgtgagctactgtgcctggcataggttgtttttaatacagaaaaatattttaaaaaccagaagcagcccataatcctagtagccttgataactcttatttaacatttaaatttaaaatgaaataatatctttgcatctttaagaaattttcagga

SEQ ID NO: 41027 - DNA, 135 bp, Homo sapiens
  misc_feature 6, 32: n = A,T,C or G
atgtgncttcggaaacttaataatatgaatgntttttcaggataaattttaatttccagtcactcacaaattgtaaaatacaaatagttcaaaagctatagaagtatttgaaaacattgataaaataattgctcc

SEQ ID NO: 41028 - DNA, 104 bp, Homo sapiens
acccctaccatgagccctacaaacaactaacctgccactaatagttatgtcatccctcttattaatcatcatcctagccctaagtctggcctatgagtgactac

SEQ ID NO: 41029 - DNA, 227 bp, Homo sapiens
  misc_feature 4, 19, 28, 38, 48, 106, 136, 224, 225, 226: n = A,T,C or G
aacnatacttattcccaanaaaaaaaangcaagaattntttgcccggntcttcttcagattcagcatttgttctttaccagtctcattttcatcttcttccatggntccacagaagctttgtttcttgggcaagcnggaaaaattaaattgtacctattttgtatatgtgagatgtttaaataaattgtgaaaaaaatgaaataaagcatgtttggttttccannng

SEQ ID NO: 41030 - DNA, 180 bp, Homo sapiens
  misc_feature 32: n = A,T,C or G
acagactgtctatgtaacatgtagcgcacacntctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacg

SEQ ID NO: 41031 - DNA, 490 bp, Homo sapiens
  misc_feature 56, 148, 170, 428: n = A,T,C or G
cattccgccttttttatacatatatttttttcttaaatatttaaccttaggaaagnctgagaattatgcatcatttctcacagaagttgagagagtttttttttcctgttaaacagtctatttttaatgatttctctattggcatggngaggcaagccaggttaattcangaggataatgtctaatggaatgtttcagaaaattatcttctttttagtctctacttttctgaatgtataaagaacctgtgtataccgtatttcttagatttcaggttaacttgttcagaaaggccattttactgaataaatttttatttcgatgaaaatccttacttcctttgtattgggctcagagagcacactctgtctctatatgaatatggacagttagcatttgccaacatgtatctattttctcttatttgnagaaaaagctaaactaaaaagggggttataagaaggtcagcaaaggatgggtttgagatgtt

SEQ ID NO: 41032 - DNA, 498 bp, Homo sapiens
  misc_feature 2, 3, 28, 53, 61, 64, 65, 69, 79, 110: n = A,T,C or G
cnnattgcgcctctttcttctcaaacantggatgtcacaaaactatgagagcngacaacantgnngacnggtagctggnacctaggctatcttaccatgaagggtgcctngcttattgtatatttgtgtatgtagatgtaactacttttgtacaatagaggactgtaactactatttaggttgtacaggattgaaatttagttgtttcattggctgtctgaggaggtgtggacttttatatatagatctacataaaaactgctacatgacaaaaaccacacctaaagaaattttaagaatttggcacagttacctcactttgtgtaatctgaaatctagctgctgaatacgctgaagtaaatccttgttcactgaagtctttcaattgagctggttgaatactctgaaaaatgctcagttctaactaatgaaatggatttcccagtaggggtttctgcatatcacctgtatagtagttatatgcatatgtttctgtgc

SEQ ID NO: 41033 - DNA, 315 bp, Homo sapiens
atggaaactggggattactgaggttatttgcccaaggtaacacagatggtagattctggagccagagttggaaactgggtagtttgctccagacccaatgatctagcatcctagatgtggtccattagggctctctcttttcatccgtttgtaaaagagaagttttcactttcttctcaaaccattgagaaacaacttggaactggaagtgcaaagggagaattctaaagaaagcgttttaaaaaggagaaagaacaagaaagcaggacaccatttcctacctttggtattctccaaatagttggcaccaattct

SEQ ID NO: 41034 - DNA, 381 bp, Homo sapiens
  misc_feature 342, 366, 371: n = A,T,C or G
aggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggngatattcctggagtccgctttaanggtgncaaagtagcc

SEQ ID NO: 41035 - DNA, 173 bp, Homo sapiens
  misc_feature 16: n = A,T,C or G
cctctccctgacagangatgtaattcttcaatttttcaatcttaaaatttttaaattttatatttgtaaatacagtacacattttatttcttggattttgagagacattgttaattttgggggaattggcattgcgaaagacttgaaaactaatgagtaaagtctgctgaatg

SEQ ID NO: 41036 - DNA, 351 bp, Homo sapiens
  misc_feature 16, 350: n = A,T,C or G
atgaaaaatctctttnctactggtagaagcatatagtaggatatagtcaaagcgaatttagcataaaaatacatacactttatatctatgtatctatgtacacatactttttgatatgcatgtataactacatatttctgaaacgtttctaaaaataatcataaaatgattacagatatgcaaaaacagttatagagctatgtatagtttgttaacattaagataaaagccttaacattttttatgcttaaaaacattataatgcttcattatagcagaatacacatttgtcattaaaagagatatagagcagaatttctcagagttcagcagaatattcatagttgttnc

SEQ ID NO: 41037 - DNA, 315 bp, Homo sapiens
  misc_feature 15: n = A,T,C or G
gatcgatgatgagantaattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaac

SEQ ID NO: 41038 - DNA, 471 bp, Homo sapiens
  misc_feature 25: n = A,T,C or G
gaacagaatctgacagtgatgaatnagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttacctagagtcactatccggaaatctaagaatatcctctttgtcatcacaaaaccagatgtctacaagagccctgcttcagatacttacatagttttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgttagaagttaaggacatag

SEQ ID NO: 41039 - DNA, 468 bp, Homo sapiens
aagcaagaaaggcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggactatgtgttgcaagactaattggctataattatatcctatcaaagaaatcgatacgtaatagcagattgttttatattcattccattttgatggtgttatttaaattgattctctgttataagagtaaactgatgagtcgaagtct

SEQ ID NO: 41040 - DNA, 362 bp, Homo sapiens
cagtgagcatcacaaaaatgcaaatttaaatttcaatctggatggaaagttataaaattcactgcaagtaatgggtggttgggtaggtttaagaaatgccaggtgggtggatcacttgaggtctggagtttgcaactagcctggccaacatggtgaaaccttgtctctactaaaaatacaaaaattagccaggattggtggcgggtacctgtaatctcagctactcaggaggctgaggcaggagaatcgcttgaacctaggaggcagaggttgcagtgagctgagatcgtgccatcgcactccagcctgggtgacgagagcaaagctctgtctcaaaaaaagaaaagaagagaagagaaaag

SEQ ID NO: 41041 - DNA, 473 bp, Homo sapiens
  misc_feature 24: n = A,T,C or G
aacataaatgaccttttacttgcnttgtatcttatactaaaggctttagaaattacaacatatcaggttctcctactactgaagtagccttccgtgagaacacaccacgtgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcgcaaagcagggaatggttcatttactcttaatctttatgccctggagaagacctacttgaacagggcatattttttagacttctgaacatcagtatgttcgagggtac

SEQ ID NO: 41042 - DNA, 140 bp, Homo sapiens
  misc_feature 5, 6, 25, 26: n = A,T,C or G
cggcnntttattggccgggagattnntaaaatattcgagggtttgggagtcacagaccctcccctctcctcagtgcactttagcatttgcacggtgtcttccccggacagcacagcaataaatggtgtgattgcgtggat

SEQ ID NO: 41043 - DNA, 499 bp, Homo sapiens
  misc_feature 8: n = A,T,C or G
tccggctnttattggccggggctaagagtcaggaggaggagatgaagtcaggaatacagaaaagtagttaatggaagatgataaattcagcttgggacatgctgagcttgagatgtcactgggacatgcagattcagatatcatgtgctgttagaatgaaaaactgaagcccagaaatgagcacagatacatgcacttgattttgtaattgaaactatggaaaaagattttcaagggcaaacaggaaaaagtaagaaaaagaagagtagggaaaagaatgcaaaggctctaacctttgcatatgaaagatgtttgcagagaaaaaaggattcccatggtctcacaaagccaaggaaaaaaaggtccgtcgaggaaaagtcaagtaagacaaggactagcaggtagaaagcagtttcagcagtgtggagttaaaggtcaaattgccggggattaagataatgaagatgagggggcttagtggttaagagctctggagttg

SEQ ID NO: 41044 - DNA, 413 bp, Homo sapiens
  misc_feature 5: n = A,T,C or G
aaccnctggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacaagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacat

SEQ ID NO: 41045 - DNA, 489 bp, Homo sapiens
  misc_feature 2, 164: n = A,T,C or G
anacatggctctgttacgaaaaattaatcggtgctgctgttccttctgatcgtgaccctctgtgtgattctgtataagaaagttcataaggggactgtgcccaagaatgacgcagatgatgaatccgagactcctgaagaactggaagaagagattcctgtggngatttgtgctgagagggaggatgagtgccactatggctgccatcaatagcatctacagcaacactgacgccaacatcttgttctatgtagtgggactccggaatactctgactcgaatacgaaaatggattgaacattccaaactgagagaaataaactttaaaatcgtggaatccaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaagg

SEQ ID NO: 41046 - DNA, 117 bp, Homo sapiens
  misc_feature 5, 15: n = A,T,C or G
tggcngggaaagaanaatttggtataattctggtgggtgattattttttatactgtatgtgccaaagctttactactgtggaaagacaactgttttaataaaagatttacattccac

SEQ ID NO: 41047 - DNA, 494 bp, Homo sapiens
  misc_feature 5, 49, 58, 396, 437, 476: n = A,T,C or G
gaagnctcggcaattattggccgggggggaggttggctggctcttattnagtgtctgncctcaggttcattctaatgattctggcctcctcccttgactcttctaagcatattttctctgggagtgtctgagggcagccctacccaggccacaaggccaccaattactgagtcacagctccaggggagcttaagtgacctccctttgaccctggcctggacctctgtttcttcacccgttcaccaccgcctcctcctcgtccagtcctggccttcacccgaaagcccctatggttgacctttgctactggttgggaattctagtctttgtcctccttccagttgattcattataccctgtggtttgggagggcttttcagagcaagctcacaaagngggcaaaattccaacctttggctgaatggatggggacaganagaaaattagggccataaggaactgctaaatctaatgtngttcctcccttaagatat

SEQ ID NO: 41048 - DNA, 177 bp, Homo sapiens
  misc_feature 5, 13, 142: n = A,T,C or G
cgaantcttaagncggtggatcactcggctcgtgcgtcgatgaagaacgcagctagctgcgagaattaatgtgaattgcaggacacattgatcatcgacacttcgaacgcacttgcggccccgggttcctcccggggctacncctgtctgagcgtcgcttgccgatcaatcgcccct

SEQ ID NO: 41049 - DNA, 117 bp, Homo sapiens
gaaacaatttggagaagatagaagtttgaagtggaaaactggaagtacagaagtacgggaaggcgaagaaaagaatagagaagatagggaaattagaagataaaaacatacttttag

SEQ ID NO: 41050 - DNA, 259 bp, Homo sapiens
  misc_feature 12, 197: n = A,T,C or G
attggccggganggtcggagcatcagaacaagacgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgnattttctgattttataccaactgtgtggactaagatgcattaaaataaacatcagagtaacg

SEQ ID NO: 41051 - DNA, 160 bp, Homo sapiens
acggccgggcattacagctgtgttttacttttggacagaatttttatttgtatagagtgcttactaatgttaaatagttcagagtatataacatttacattaaggactcatggtaggttttagggtaaggagtttaaaggaaataagtattcaaactggg

SEQ ID NO: 41052 - DNA, 287 bp, Homo sapiens
cattactttttaaagtaaggaacaaaggtgtaatcccagcactttggggaggctgaggcaggcgggtcacgaggtcgggagttcgggaccagcctggccaatacggtggggccctgtctctactgaaagtacaaaggttagccaggcgtggtggcgggtgcctgtggtcccagctacttgggaggctgaggcgggagagttgcttgagcccgggaggtgaaggttgcggtgagtcgaggtcctgccattgcgctccagcctgggtgacagagcaagactccaacttt

SEQ ID NO: 41053 - DNA, 469 bp, Homo sapiens
aaaaactaacaaacagaaaggaatagcatcaacatcaactaaaaggatatccacaccaaaaccccatctctaggtcaccaacatcaaagaccaaaggtagtatagaaccacaaagatagggagaaaccagagcagaaaagctgaaaattctaaagaccagaggacctcttctcctacaaaggattgcagctcctcaccagcaacagaacaacgctggatggagaatgactttgatgagttgacggaagtaggcttcagaaggtcggtagtaacaaacttctccgagcgaaaggagcatgttcaaacccatctcaaggaaggtaaaaaccttgaaaaaaggttagacaaatggctaacctagaataaacagtgtaggagaacaccttaaatgacctgttggaactgagaactgtggcacgagagctttgtgacacatgcacaagcttcaatagccgattcgatcaagtgg

SEQ ID NO: 41054 - DNA, 106 bp, Homo sapiens
  misc_feature 6, 7: n = A,T,C or G
atgganngggatttctttctagttccattattaaaccctccttgaattaaccttactggagtatgccatgtttcctgctgggaccatgactgtgtttgaaactccg

SEQ ID NO: 41055 - DNA, 392 bp, Homo sapiens
atagtaatttcctatgtttttaacttaatagttttgcccataaataccaaaaggaataaaaaaggaaggactttttacaagtgttatttatttgtaggccaaatattctgcctgtcacctatcttaggatgctttttacctttctgatttctttttttctgatttgttttttcttgtgtaattgcagctttggctttacagataaagtaataaagaagagccagtgtcccattggggtctttggcaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattc

SEQ ID NO: 41056 - DNA, 488 bp, Homo sapiens
  misc_feature 66, 460: n = A,T,C or G
attgctggactagcaaaggaaaattgcactattgcacatcatattctattgtttactataaaaatnatgtgataactgattattacttctgtttctcttttggtttctgcttctctcttctctcaacccctttgtaatggtttgggggcagactcttaaatatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagnttgaagtcaaatgtcacataggcaaagc

SEQ ID NO: 41057 - DNA, 466 bp, Homo sapiens; identical to SEQ ID NO: 28984

SEQ ID NO: 41058 - DNA, 406 bp, Homo sapiens
actgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgcttggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaacatgtcg

SEQ ID NO: 41059 - DNA, 464 bp, Homo sapiens
tacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagcccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattat

SEQ ID NO: 41060 - DNA, 470 bp, Homo sapiens
  misc_feature 127, 171, 199, 403, 459: n = A,T,C or G
agggaacgtgagctgggtttagaccgtcgtgagacaggttagttttaccctactgatgatgtgttgttgccttttttttttatttattaccattatatattatattatattatatatttttggcttncttataactttggaggaaagtcaaatcttggtattattaaaatngttttaaaaaggagtaaattttccagtngataaatgaaaatcactggcctatgtttaataagtttttctttaattactggggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgngaataaaatttagctgccttgtatagtcgtttgaaagaatatgtgatctgtgaganaattatagttt

SEQ ID NO: 41061 - DNA, 468 bp, Homo sapiens
  misc_feature 10, 12, 18, 40, 101: n = A,T,C or G
gctttttcgnancgggtntgccgccaggaacacaggtgtngggaaaactacccctaaaagccaaaatgggaataggaaaagactcatatcaacattgtcgncattggacacgtagattcgggcaagtccaccactactggccgtctgatctataaatgcggtggcatcgacaaaagaaccattgaaaaatttgagaaggaggctgctgagatgggaaagggctccttcaagtatgcctgggtcttggataaactgaaagctgagcgtgaacgtgggatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccga

SEQ ID NO: 41062 - DNA, 388 bp, Homo sapiens
accaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 41063 - DNA, 107 bp, Homo sapiens
acagtatgtatattttacaatttttaaaattggaaaaagtaaaattaattactctaagttacagagaaattacctaccgataataaaagttaagtatattttcatcc

SEQ ID NO: 41064 - DNA, 471 bp, Homo sapiens
  misc_feature 26: n = A,T,C or G
gtcctccaagaatttggggcgcggantggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgaagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgactcattctcatttacttaattgaggagtaggagactaaaagaatgttcactctttgaatttcctggataagagttctggaga

SEQ ID NO: 41065 - DNA, 303 bp, Homo sapiens
  misc_feature 13, 19: n = A,T,C or G
ggcccggggaaanttgaanccctagtaacctgttaatcaccctttaaaaagtaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctg

SEQ ID NO: 41066 - DNA, 472 bp, Homo sapiens
  misc_feature 11, 20, 21, 66: n = A,T,C or G
agcatttggantaccttgtnnttctctactcttacaaataacacctgaagcaagaatgaccaatanttctgataattggcactggatcacaaaatgtgataaaactttaaatgtataaaactttatcaaataaagttttattttcccctttaaaatgtatttctttagaggcattactttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatatttctatgggctgtttgtaatttctctttttttccttttttattttggtgctgaatatgtccttgtaggctctgttttaagaaaacaatatgtgggaaatgatttaaatttttcctattgctcttccttgtggaaaat

SEQ ID NO: 41067 - DNA, 467 bp, Homo sapiens
  misc_feature 368: n = A,T,C or G
agtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggngtgtttcgtgggaacaactgggcctgggatggggcttcactgctgtgacttcctcctgccaggggatttggggctttcttgaaagacagtccaagccct

SEQ ID NO: 41068 - DNA, 473 bp, Homo sapiens
cattgagacagcataggcctgtgaagcctgacaaacttgaattcagatattgtttcaacagttcatatctgtgtccttgatcacttcataagcctcagtttcctcctctataaaatcagaaaaataattgctactttacatggttgttagagataacgagtatgaagtacctcacactgagcctgtatatagttgatcctcagtaaaacagttatcattataagtaaaatgaggttgagaatgttgctctgttatactgatctccaaatggggctaaaacaatttgcataatctgattcctctatctgtccatgcgtatatatttatatcaggtgtggacagacttttccactctgcaatatattacttaaatatatatcagaaaagtttgcctatcttattattcctaatcttctgaaaaaaaaattcacaataaaagagtactatttttaaggctttgtccattatactta

SEQ ID NO: 41069 - DNA, 500 bp, Homo sapiens
  misc_feature 6, 9: n = A,T,C or G
tctcgnctntttatggagcgggtcctctctgcccctaaaacagtaaatatgatcatgttattctcctacttacatgcccgtcagtggctccccagtgccgtactgctgtggcacacagaaccctacgtgatctggtcctgcgtgctctgtaagtggcaagtcccagggcctcttcgtgcaggctgttcaagggggtctcataacctaccagtccgagttagacttgttgagtcttaaaaccaagctgctttgagttgggtcttcagatgaactgggaatcaacatatttgggatggatctgtagggtgcatttaaaaggcactgaatgtttggaatggagtgcaagaattaatgttaagttaccaggagaaaattgaggtattaagggatctgcgcatatagttttcaaaaatcaattaaacaaaaagcctgttttttaactgattctatagttcatttggaagactatgtatattacattatatcatatatctacatgt

SEQ ID NO: 41070 - DNA, 460 bp, Homo sapiens
ctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacaggagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccaga

SEQ ID NO: 41071 - DNA, 286 bp, Homo sapiens
  misc_feature 285: n = A,T,C or G
cacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaanc

SEQ ID NO: 41072 - DNA, 130 bp, Homo sapiens
gaaaacacttagtatgcagttgataagaggaatttggtataattatggtgggtgattattttttatactgtatgtgccaaagctttactactgtggaaagacaactgttttaataaaagatttacattac

SEQ ID NO: 41073 - DNA, 226 bp, Homo sapiens
agatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatg

SEQ ID NO: 41074 - DNA, 465 bp, Homo sapiens
  misc_feature 12, 13, 109: n = A,T,C or G
gaaatttcggcnntttatggcccggggctttccaacttggacgctgcagaatggctcccgcaaagaagggtggcgagaagaaaaagggccgttctgccatcaacgaagnggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtgggatgagaactaatcgctgatcgtcagatcaaataaagttataaaattg

SEQ ID NO: 41075 - DNA, 461 bp, Homo sapiens
agtaggattgcatctgaaaggggttagtggacctgtatgcggattcagatcaactggtgttggaagttatgtagagatgtcatggcatccataagcgcagggccttgtgatgctcaaaaacatacttggattggatcagtgttgtttgtcacaaaaaaggcaacttgttctttgagaagcctcattttttattttttaaatgttgatttttttatgagtagttgctgtgtgggatctggatataaagattaaattctcatcagagagggagtgagtgatacattatgttctttgctgaaagaccatgtgtctcggaggctgaagcaaaggaaataaacacactctcctggtgtttatgggggtttcctcattgttccctgatataattcagtttaagagttggtgacagaagcagatgccctatattcatgggatgttccatctcacttcatgacttactg

SEQ ID NO: 41076 - DNA, 123 bp, Homo sapiens
caggcatgctcataaggaaaggttaaaaaaagtaaaaggaactcggcaaatcttaccccgcctgtttaccaaaaacatcacctctagcatcaccagtattagaggcaccgcctgcccagtgac

SEQ ID NO: 41077 - DNA, 402 bp, Homo sapiens
  misc_feature 2, 16, 87: n = A,T,C or G
cngttttgcagacgcnccgccgaggaaaaccgtgtactattagccatggtcaaccccaccgtgttcttcgacattgccgtcgacggngagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagact

SEQ ID NO: 41078 - DNA, 220 bp, Homo sapiens; identical to SEQ ID NO: 38012
  misc_feature 218: n = A,T,C or G

SEQ ID NO: 41079 - DNA, 442 bp, Homo sapiens
  misc_feature 37: n = A,T,C or G
attgtgtactttcttcaatgccggcactcttctaacnctttatatgtattagctcatcagactcagcctgataatatgggatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttgggaggccaaggcaggaggactgcttgggccgggagtttgagaccagcctggacaacggagtgagattcatctctac

SEQ ID NO: 41080 - DNA, 325 bp, Homo sapiens
catgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttac

SEQ ID NO: 41081 - DNA, 472 bp, Homo sapiens
  misc_feature 327, 374: n = A,T,C or G
cgcataaacagaaccaatgacaaaaaccacatgattatctcaatagatgcagaaaaggccttcaataaaattcaacaccctttcatgctaaaaacactcaataaactaggtattgatggaacatatctcaagataataagagctatttatgacagacccacagccaatatcatactgaatgggtaaaagctggaagcattccctttgaaaactggcacaaaaccaggatgccctctttcaccactcctattcgacatagtatttgaaagttctggccagggcaatcaggcaagagataaaaataaaggatattcatccaggaagagnaggaagtcaaattgtctctgtttgcaaatgacatgattgtatatttnagaaaaccctgtcgtctcagccaaaatctccttaagctgataagcaacttcagcaaagcctcaggatacaaaatcaatgtgcaaaaatcacaagcatt

SEQ ID NO: 41082 - DNA, 209 bp, Homo sapiens
acaaggcaaaatagaaaagaatgatctaaaaattattatgaagaagataatacatatgaaaaagaaaatagatataaattagtgttcctgaaaaaagagaacagaacaaatggattaaagacaatattaagatatttataaataaaagggaaaattttctggttgtaccactttattctagcctgggaaacagagcaagaccctatccc

SEQ ID NO: 41083 - DNA, 381 bp, Homo sapiens
  misc_feature 192, 215, 351: n = A,T,C or G
gacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccggggttgattatttttattgcttcaaaagcagnggactgtcttttggattcaaagngggcaaaggccaagaaaggagaggaagctttatttacaaccagggagtctgtggttgactactgcaacaggcttttaaagaagcagttttttcaccgagccctaaaagtaatgaaaatgaaatatggataaagacntaaagaaaggaaaaagataaagggaaaagc

SEQ ID NO: 41084 - DNA, 110 bp, Homo sapiens
  misc_feature 65, 70: n = A,T,C or G
tacggtggctcacacctgtaatctcagcactttgggaggccgaggtgggcggatcacctgaggcnagganttcaagactagcctgggcaatacagtgagacctcgtctct

SEQ ID NO: 41085 - DNA, 461 bp, Homo sapiens
acaactcggtggcggccactgcgcagaaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaaga

SEQ ID NO: 41086 - DNA, 471 bp, Homo sapiens
gattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagaattctttcccctgctgagttggaaattccagtgcagcactgattggccacagttg

SEQ ID NO: 41087 - DNA, 461 bp, Homo sapiens
  misc_feature 461: n = A,T,C or G
gctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagagggaggaagacgaggattaaatttcatttatctggaaaattttgtatgagttcttgaataaaacttgggan

SEQ ID NO: 41088 - DNA, 470 bp, Homo sapiens
  misc_feature 10: n = A,T,C or G
agtttttatnagacttaagtttaactgcagatgggtttattggtcactacctattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggggtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaaagatgggcgaggcaaaatcatgccaaacagctttatcattgatgttcaagaccaagaatcaga

SEQ ID NO: 41089 - DNA, 376 bp, Homo sapiens
aagatacgtcatttctgtattggcaaaatgccctattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcactttttaaaactttccaagctagctacttattttcattttcagggttgagtactctaagctctctacttactgtgagaagttttctacattgtaaaattaaaagattatatttaaaatacttctttaggatgttattcagccatcaaaaaaaaaaccaactaaaatgtcttaccagtaaagtattattaaaagc

SEQ ID NO: 41090 - DNA, 358 bp, Homo sapiens
  misc_feature 277: n = A,T,C or G
cagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaaganaattacttccccactgatggagcccagcagcattgagaaaattgtaagagattgatgctcacataggttgtgccatgagtg

SEQ ID NO: 41091 - DNA, 473 bp, Homo sapiens
gtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatatttgtatttggtattataagaaatctagagatgatttaaattatacaggaaggtgtgcgtaggttaccgtgcaaacgctatgccattgcccatcagggacttgagcatcctcagatgtcggtgtctgagggttgaggttgcagtcctggaacccatcccccatggatactgaggcatagctgactgtgtgttttcactttgctttcagaactacgac

SEQ ID NO: 41092 - DNA, 324 bp, Homo sapiens
caggattaataattcttcttttaaaaatactaatgtccatgtatgttgaatgaatgtaaactactttctgctgcttccaccagttgagatgaatgctcatggaagttataggtttcttcccaaattggctaattctattgtacttgtaatgtgtttatattattctactaagtattacgtaaaccaatgataaatgaatgtgaaaagagaactgtttaaacgcaaactaagttaaatgctttggaaaacttgataaaggcaaattaattgctgaagaaaattgtagtcagtttaggtgtgggcaagatgactaaaagattacag

SEQ ID NO: 41093 - DNA, 299 bp, Homo sapiens
aagtgttatatataatatgttaaaaacattttgctttcctggctaattatttgatccttttaaattcaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactc

SEQ ID NO: 41094 - DNA, 145 bp, Homo sapiens
gaacactgtaggctttaaaagtctagaatttttactcaggaggctgagacaggagaattgtttgaacccgggaggtggaggttgtggtgagccgggattgcatcattgcactctagcctgggcaacaagagctaaactccatgtc

SEQ ID NO: 41095 - DNA, 471 bp, Homo sapiens
gctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggatttgtagagccatatattgcttggggggtaccccaatctgaagtca

SEQ ID NO: 41096 - DNA, 357 bp, Homo sapiens
aactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtattgtttgtggtataggaatgtcatggtaaattgtttttcaataaatattttgaaacatc

SEQ ID NO: 41097 - DNA, 278 bp, Homo sapiens
  misc_feature 32, 165: n = A,T,C or G
gttcagcaaatccgtcttccgcaattactggncttccaccaaatccagatcttccaggaaaatccacgtcttccaggaaatccatgtcttccaataatttcaaggtcttccatcaaatacagatcttccagctaatccatgtcttccagaaaaatctgtgtcttncaccaaatccaagtcttccagtaaatctagttcttccagaaaaatctagatcttccagtcaatcagtgtcttccagaaagaaatccaggtcttccagtcaatcagtgtcttgc

SEQ ID NO: 41098 - DNA, 471 bp, Homo sapiens
actccaagcacgtgaattactccttggtattgagataagcatttctgaagattcttctatttctacaagccagtagctctttgaacggacttttattgtcatttatctaagtggcctaaaataatgaataaactgctgaaagagtttgccctattcccaggaattatttcacacactgaaagaatctgtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgctgggcagtcaggtttgtaacacctat

SEQ ID NO: 41099 - DNA, 471 bp, Homo sapiens
  misc_feature 36, 37, 58: n = A,T,C or G
aacaatacattgagcagagccaggcagaaatttatnntaaccggtttgatgctgtgcnctcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttct

SEQ ID NO: 41100 - DNA, 469 bp, Homo sapiens
  misc_feature 332: n = A,T,C or G
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaacggaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggnaagaagaggagacttcaaatgaaggagaaaacaatgaagaatcgaatgaagatgaagactctgaggctgagaataccacactttctgctacaacactgggctatggagaggacgccacgcctggcacagggtataca

SEQ ID NO: 41101 - DNA, 322 bp, Homo sapiens
  misc_feature 9, 18, 43, 44, 318: n = A,T,C or G
tgtaagaangcccttaantaaagaaggtaagaaacctaggacnnaagccccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctganaaac

SEQ ID NO: 41102 - DNA, 329 bp, Homo sapiens
  misc_feature 236: n = A,T,C or G
gttgcccaggctggagtgcaaatggcttgatcttggttcactgcaacctctgcctcccaggttcaagcaattctcttgcctcagcctcccgagtagctgggactgaaggcgtgtgccaccatgcccagctaattcttgtatttttagtagagacggagtttctccatgttggccagactggtctcaaactcctgacctcaggtgatctgaccgccttggcctccgaaagtgctganattacagttgcgagccactgtgcgtggccagaactttataataagagacttgaagctgggtgtgacggggcacgcctctggtcccaacctact

SEQ ID NO: 41103 - DNA, 277 bp, Homo sapiens
caatatagcatataaatattatgccctcattccttctcttgttaaaggtagaagaataaaattgtgatttttataacctgtgcttattactcaaatggtcttcaacatctttttaaacaacacatactttttgaatgttcagtttctattttgcttgaggtattttgtacatatgtgccttgtgattgctgctgctttaaaggataaagtactctttgggggatgagtctggcttgttttgttttattttttaatgaagtaaacctatattcctgat

SEQ ID NO: 41104 - DNA, 470 bp, Homo sapiens
tacctccgctaccataattatcgctatccccaccggcgtcaaagtatttagctgactcgccacactccacggaagcaatatgaaatgatctgctgcagtgctctgagccctaggattcatctttcttttcaccgtagggggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctc

SEQ ID NO: 41105 - DNA, 162 bp, Homo sapiens
gtacccacaaatggtgatatactttgtttctactgaaaaatgtattgtgctttgatactaaaaatctgtaaaatgttagttttggtaattttttttctgctggtggatttacatattaaattttttctgctggtggataaacattaaaattaatcatgttcc

SEQ ID NO: 41106 - DNA, 418 bp, Homo sapiens
  misc_feature 15, 16, 21, 23, 33: n = A,T,C or G
accagtagggttgannagagncnctaaggaaanttagaagtacctgtactttttgctcttggaaatgaaatacttgtttcctgcacctttgaaaaaaataacaggattttacagccttctgatgattccttcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttg

SEQ ID NO: 41107 - DNA, 498 bp, Homo sapiens
  misc_feature 9, 16: n = A,T,C or G
cccgggaanctcggcnactttggccgggcagtaaaggaggtggggtagagaattcaatcgtgggctatctctccagagatgtgtttacaggtgtgtataaagagtgctggcagactcaaggaggacacatgtgactgtgctggtggttagaattatgatcttggataaaatgaaactgcatagatattcaagtgaggctttgtaaactacagagataaagaagccatgccagtttaagagcattagagaaatccctcagcttggcctagaaaatgtccctcgataagagaaacagacggatctagctgaccagctgccagctttcacttcttacggccacgctgagttagctggaatcatcttagcattgcaagatagatggctctaccttgtggtagtccaagctggagggtggtaagtagtcagagcagctaatataataccatctttaggcttacagtttgatccataatttcccttccataatttattttaatt

SEQ ID NO: 41108 - DNA, 103 bp, Homo sapiens
  misc_feature 1, 12, 17, 22, 23, 47, 65, 78: n = A,T,C or G
natttagaagcntgccnagaannagacctggtgaaaaagtaaacccntttcacctacaaaatttnaccctgcaaaccnttaaaaccctgcaaaattttccttt

SEQ ID NO: 41109 - DNA, 121 bp, Homo sapiens
  misc_feature 6, 11, 15, 19, 50, 120: n = A,T,C or G
aaaganaaacnaatnaacntgacaaagaagttgacctgaacatgtaaccnctgccctaccctgttaccttgcttagctgcaaaataaacttgttgctgacctgctgtgctcgcagtagana

SEQ ID NO: 41110 - DNA, 347 bp, Homo sapiens
  misc_feature 15: n = A,T,C or G
ctctcttaagaagangatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactg

SEQ ID NO: 41111 - DNA, 325 bp, Homo sapiens
  misc_feature 14, 23, 24: n = A,T,C or G
cagggtgttgaccntttttagcnnttgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctg

SEQ ID NO: 41112 - DNA, 461 bp, Homo sapiens
gctaaacctagccccaaacccactccaccttactaccagacaaccttagccaaaccatttacccaaataaagtataggcgatagaaattgaaacctggcgcaatagatatagtaccacaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttatagggtaggaggcgacaaacctaccgagcctggtgatagcttggttgtccaagatagaatcttagttcaactttaaatttgcccacagaaccctctaaatcccttgtaaatttaactgttagtccaaagaggaacagctctttggacactagg

SEQ ID NO: 41113 - DNA, 471 bp, Homo sapiens
  misc_feature 1, 11, 94, 124, 127, 187, 241, 272, 309, 318, 370: n = A,T,C or G
nattgtacagnctttggggtgtgatatgctatttgtctttccaaggaggcagtcttcaaagaaaaaaaaaaagacaaagcagcctatactcagngttaagaattgctgcttacttttgatgttnggncaagagctggcactgctagagatgttctgccttttgaggcacagctcatgccatccatgngagcacagagtctcatcagcattcacatcttacctgctactggtctcacactgnggaaatgggtaatagaaacagaaacatcagngacattttgggctcttttattcagaggaatcaaaagngacaaaganaagccagggtcagcagtaggcagtaggtccacccattgggatagcatagctnttggggaaattgtcagcacagaggcaaaaccatggtatttcccgtgactgcagcaggaggtctgcagttgtgactttagccaagaagcattgggaatccaa

SEQ ID NO: 41114 - DNA, 468 bp, Homo sapiens
  misc_feature 3, 10, 12, 16, 18, 20, 22, 25, 29, 33, 36, 40, 45, 65, 67,68, 74, 76, 93, 183, 184: n = A,T,C or G
aangtaacgngnccanantnanganctangaanacnagcnaggcngaagtgcacatgagagacananngtacgngntctcaaccaagaaccanccagatgacatgtttttctgtgtggcaacctgcccttaaattgtcagatcttaactatcttgtgtttgctgtgcttgcagccataagctnncctccttttttgcttatcccctggctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccat

SEQ ID NO: 41115 - DNA, 322 bp, Homo sapiens
  misc_feature 2, 21, 35, 57: n = A,T,C or G
cnccccccgggaatctcggcntctttggccggggnagttaatcacccacctagggcntgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattggtgttgtgcagcattaaaaaaaatcaaaataaaaattaaatgtgaac

SEQ ID NO: 41116 - DNA, 140 bp, Homo sapiens
  misc_feature 77: n = A,T,C or G
gatgaccagatttgatctcagcctgatgaccctacaggtcgtgctatgatatggagtcctcatgggtaaagcaggangagagtgggaaagagaaccaccccactctgtcttcatatttgcatttcatgtttaacctccgg

SEQ ID NO: 41117 - DNA, 473 bp, Homo sapiens
caaagagtgaagatgcaggtggtgctgaaggagaaacacctcatatgcttctcaggccccatgtgttcatgcctgaagttactcccgacatggattacttaccgagagtacccaatcaaggcattatcatcaatcccatgctttccgatgagaccaatatatgcaatggtaagccagtagatggactgactactttgcgcaatgggacattagttgcattccgaggtcattatttctggatgctaagtccattcagtccaccatctccagctcgcagaattactgaagtttggggtattccttcccccattgatactgtttttactaggtgcaactgtgaaggaaaaactttcttctttaaggattctcagtactggcgttttaccaatgatataaaagatgcagggtaccccaaaccaattttcaaaggatttggaggactaactggacaaatagtggcagcgctttcaaca

SEQ ID NO: 41118 - DNA, 470 bp, Homo sapiens
  misc_feature 109: n = A,T,C or G
cagatgactggcctttacagtaagagtaaaaggaggtcagagtagaaggatgtcagatcatgtaggatttgtaggcccctttgagaactttagattttattattctgcntgagattggaaaccactggagttctgaggcaaagaacatataatttggtttactttctaaagcaattgctctgagagcttaaaaaaagaataaaatttaggaaggcaaaaggggaagcaggaataataatcagggcaacttcaatcatttggaaggaaacaatggtgacttggacaaggttgtcggagtagaggtggagagaactagattaagtgtacattttgaaggctgagctagcaagatttgttgttgattatgtagagagcataagagaattggagctcaaggataatgacaatgtatatagcctgagcatctgaaatgattggcatgcaatttactgagatggggaagacaagac

SEQ ID NO: 41119 - DNA, 140 bp, Homo sapiens
gagacaacttcccaagccaaagcagtttttccccctaggggtgggaggaagcaaaagactctgtacctattttgtatgtgtataataatttgagatgtttttaattattttgattgctggaataaagcatgtggaaatga

SEQ ID NO: 41120 - DNA, 322 bp, Homo sapiens
accaagaggacaccacggtgaaagaagagcaccaactgtgcctatgacaggattgtgcttagaggacaagaaatcgtcagttctgttgttcccaagtcaaacagtgatttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacata

SEQ ID NO: 41121 - DNA, 464 bp, Homo sapiens
ctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcagga

SEQ ID NO: 41122 - DNA, 465 bp, Homo sapiens
  misc_feature 210, 421, 425: n = A,T,C or G
ctcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtntctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtgaaggtnagtntaaataaacaagaaaaacttcttcggaaggcatggcgaag

SEQ ID NO: 41123 - DNA, 470 bp, Homo sapiens
  misc_feature 25: n = A,T,C or G
aattacatcttgatggcacaaaatngcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtaccttggtgggcttggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaat

SEQ ID NO: 41124 - DNA, 355 bp, Homo sapiens
  misc_feature 11, 40, 58: n = A,T,C or G
taacccgagantacaccatcaacattcacaagcgcatccntggagtgggcttcaagangcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgagggatgaagattcaccaaataagctatatactttggttacctatgtacctgttaccactttcaaaaatctacagacagccaatgtggatgagaactaatcgctgatcgtcagatcaaataaagttataaaattgc

SEQ ID NO: 41125 - DNA, 177 bp, Homo sapiens
  misc_feature 54: n = A,T,C or G
caacactggtgtacatatgtccgctgggtgagttgacctgtggcctcgcacagngattctgggccctttatgcttgctgtctctcagaattgttttcttaccttttaatgtaatgacgagtgtgcttcagtttgtttagcaaaaccactctcttgaatcacgttaacttttgagatt

SEQ ID NO: 41126 - DNA, 288 bp, Homo sapiens
  misc_feature 1, 8, 25, 58, 59, 79, 113, 177, 187, 234, 254, 270: n = A,T,C or G
nttatggnccgggggcttttgctgngtctactgcgagaatgaagtactattctcagcnntcagactgtcgacattccangaaaatgtcgaccttactctgaagggacgcacanttatcgtgaagggccccagaggaaccctgcggagggacttcaatcacatcaatgtagaactcanccttcttggnaagaaaaaaaagaggctccgggggtgacaacatgggggggtaacacnaaaggaactggctacccgtncggactatttgtaggncatgtacagaacatgatc

SEQ ID NO: 41127 - DNA, 469 bp, Homo sapiens
ctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctctcaacacaagcgagatgaagaaactgatcacccacatgggggagatggaccacccctggaactgtccccatggaaggccaaccatgagacacatcgccaacctggctgtcatttctcagaactgaccgtagtcactgtatggaataatttgggttttatcgcagatttttatggtttttgaaagacagagtcttcactaaccttttttgttttaaaatgaacctgctactt

SEQ ID NO: 41128 - DNA, 468 bp, Homo sapiens
cttttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctcccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagacccaggtgttgcttgttcagtatctcaagcccagaaagatgaattaatccttgaagg

SEQ ID NO: 41129 - DNA, 161 bp, Homo sapiens
tgcccagtgctctgaatgtcaaagtgaagaaattaatgaagcgcgggtaaacggcgggagtaactatgactctcttaaggtagccaaatgcctcgtcatctaattagtgacgcgcatgaatggatgaacgagattcccactgtccctacctactatccagc

SEQ ID NO: 41130 - DNA, 467 bp, Homo sapiens
tcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagc

SEQ ID NO: 41131 - DNA, 389 bp, Homo sapiens
  misc_feature 384, 388: n = A,T,C or G
caagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggncctnt

SEQ ID NO: 41132 - DNA, 346 bp, Homo sapiens
aagagaataaccgaaaaattgccgaagcacaagccaaactggccgaagaacagttgagaattgttgaagaacaaagaaagattcatgaggaaaggatgaaactagaacaagaacgacaacgtccacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgttttttttaatttgtaaaatctggaaagttagcttgttctaataggggctat

SEQ ID NO: 41133 - DNA, 176 bp, Homo sapiens
catgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaat

SEQ ID NO: 41134 - DNA, 456 bp, Homo sapiens
gagatgaagcttcttctggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaac

SEQ ID NO: 41135 - DNA, 266 bp, Homo sapiens
  misc_feature 35, 38, 51, 52, 62, 65: n = A,T,C or G
acgattaacagctccaatcttcttaaataaagctntgntttcctatatttnnatgaactgcnganaccccacagggaccaggtatttgtattcaaattacatttcatggtttcccattgtttcacaatgagttctaataaatgggatttactataataatccaagtatgacattagcccggtatgctttcatgaatgtttttatgtagattttcctcccatgaacatgagtaaataaatctgtttcctgaatggattgtggttgca

SEQ ID NO: 41136 - DNA, 261 bp, Homo sapiens
  misc_feature 259, 261: n = A,T,C or G
caccaatcccaagcaagcctagacttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcggcgnan

SEQ ID NO: 41137 - DNA, 293 bp, Homo sapiens
  misc_feature 33: n = A,T,C or G
cttgacacaaatgagattaaaccacaacagatnaaaacctgtagaatacaacaaaagcaatactaaagtggaagtttatagcaacaaatacctacagcaaaaaaagtagaagtatttcaaataaacaattttatgatgtccctaaaagaactagaagagtgagaatacataaaacctaaaattatcaaaaggaaagaaactgtaaagatcagaacagacctaaatgaaatatagactagaaaacagtacaaagcatcaaggaaatgagaagttggttctttgaaaatataaga

SEQ ID NO: 41138 - DNA, 225 bp, Homo sapiens
  misc_feature 124, 139, 219: n = A,T,C or G
gaggcattgaggcagccagcgcaggggcttctgctgagggggcaggcggagcttgaggaaaccgcagataagtttttttctctttgaaagatagagattaatacaactacttaaaaaatatagncaataggttactaanatattgcttagcgttaagtttttaacgtaattttaatagcttaagattttaagagaaaatatgaagacttagaagagtancttggg

SEQ ID NO: 41139 - DNA, 472 bp, Homo sapiens
  misc_feature 2, 29, 38, 54, 57, 211: n = A,T,C or G
gnccaagaacttgactgtaactggaacanaacctggtnaggtgagcagtaggtnatncagtcccagtgtcagaatgattactacctcaggaccaacctcagaaaagccaactcgaagtcatccatggacccctgatgattccacagataccaatggatcagataactccatcccaatggcttatcttacactggatcaccaactacaggcnctctagcaccgtgcccaaactccaaagaatctatggcagtgtttgaacagcattgtaaaatggcacaagaatatattgaaagttcaaacagaaattgcattgttattacaggagaaagcaagaactagttgcagaactggaccaggatgaaaaggaccagcaaaatacatctcgcctggtacaggaacataaaaagcttttagatgaaaacaaaagcctttctacttactaccagcaatacaaaaaacaactagaggtcat

SEQ ID NO: 41140 - DNA, 347 bp, Homo sapiens
gctttttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggaga

SEQ ID NO: 41141 - DNA, 368 bp, Homo sapiens
  misc_feature 5, 12, 23, 32: n = A,T,C or G
aaacnaaacagnactttataccnacaataatnaaaacaaagaagagcattacataatagtaaagggttcaattcaacaagaagatctaactatccgaaatatacatgcacccaatacaggagcacccagattcatagggcaagttctcagaaagctttacaccagtcagaatggtggatcatgaggtcaagagatcgagaccatcctggtcaacacggtgaaaccccgtctctactaaaaagacaaaaattagctgggcgtggtagccgtgtgccttgtagtcccagctactcaggaggctgaggttggagtgagccgaaatcgtgccaccgcactgcagcctggcaacagagcaagactccatccca

SEQ ID NO: 41142 - DNA, 379 bp, Homo sapiens
agatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtggggaagatttataggtaggaggcgacaaacctaccgagcctggtgatagcctggttgtccaagatagaatcttagttcaactttaaatttgcccacagaaccctctaaatccccttgtaaatttaactgttagtccaaagaggaacagctctttggacactaggaaaaaaccttgtaggagagag

SEQ ID NO: 41143 - DNA, 235 bp, Homo sapiens
  misc_feature 233: n = A,T,C or G
tatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaangt

SEQ ID NO: 41144 - DNA, 288 bp, Homo sapiens
gaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcatt

SEQ ID NO: 41145 - DNA, 296 bp, Homo sapiens
gaacagctaaaagagccacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccacta

SEQ ID NO: 41146 - DNA, 468 bp, Homo sapiens
  misc_feature 190, 215, 333, 441, 449: n = A,T,C or G
caattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggnggctattctgagatgactattcagnggctaacttgggttaggaagaaaataattaggtattttctccaaatgttcactggtactctgccactttatttctctcatctgttacacaaagaaccaccaggaaagcaaatcagttnggttggtaactctgtaattcctaactatcactggtttggttctggactaaaactacattgacagattgaatttgcctaatatgatgactgtttttaatatggatctgnatggggtnctattcagcacaaggaaat

SEQ ID NO: 41147 - DNA, 337 bp, Homo sapiens
aggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtttagaagatagaaaaatataaag

SEQ ID NO: 41148 - DNA, 194 bp, Homo sapiens
  misc_feature 37: n = A,T,C or G
gtataacattctcaggatttgtaacacttaaatgatnagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctt

SEQ ID NO: 41149 - DNA, 313 bp, Homo sapiens
agggtgagtgtttccactcaaaatatgtcaacttaaaaaaaaataggccctttcataaaaaccaaactctagcaagatgcaaatgcctggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgtc

SEQ ID NO: 41150 - DNA, 153 bp, Homo sapiens
aaataataagggttgagggggagaataaagctactgaaatatggaaagaagactaacactacttttaaactgatgttctactaatgtagacccgtacatcatatcaccattacattgtttaagcattaaagtttgcactgtaagtggctcttc

SEQ ID NO: 41151 - DNA, 410 bp, Homo sapiens
tggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagcttgatgccctcctgtatagagccaccatgattcttacagttggtggaacagcatatgccatatatgagctggctgtggcttcatttcccaagaagcaggagtgactccagtcatcccagcaatcgcttggttcagtttcattcagctctctatggaccagtaatctgataaataaccgagctcttctttggggatcaatatttattgacttgtagtaact

SEQ ID NO: 41152 - DNA, 461 bp, Homo sapiens
  misc_feature 129: n = A,T,C or G
cattcacaaaatatttatgatgtatttactctgcaccaggtcccatgccaagcactggggacacagttatggcaaagtagacaaagcatttgttcatttggagcttagagtccaggaggaatacattangataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataaga

SEQ ID NO: 41153 - DNA, 241 bp, Homo sapiens
  misc_feature 241: n = A,T,C or G
agctcttggcaccattattctgctttctgtttttgagagtctgactacttaagatacctcatacaagcgggatctggcttacatttcttgagcattgtattctggaaaagtgtttccttcctctgaaaaatgggtagagttctgaaggagaactactggtcttattgtacacttgctgtacctatttttatttaacaaatattcatctatggtataataaagatgtcatgattgagttgcn

SEQ ID NO: 41154 - DNA, 327 bp, Homo sapiens
tgcaagaggcctagcttttggcctatctcagctttcaacatgccttcctcagtaagcttaatcgtttctagcttttgatttaaagtgagggatgtacaaatcttctttcacttgaacacttagatccattttggggttattaatggcctaatttcaatattgttgtgtctctgggaatagagaggccaaggagaggaagaaagatgggggaacagctggtcagtggcatagttacaacacacacaacatttataaattaagtttgccatcttacaaaagtctaatatccagcatttataagggatcttggcaaaaaaaaccaaaacc

SEQ ID NO: 41155 - DNA, 459 bp, Homo sapiens
gtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagaggtccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggtcaggaatcacaagctccgggtggataaggcagctgctgcagcagcggcactacaagccaaatcagatgagaaggcggcgggttgcagggcaagaagcctgtggtaggtaagaaaggaaaga

SEQ ID NO: 41156 - DNA, 129 bp, Homo sapiens
aactgacggatgtaaggtgcacgtttcctgatgtgacgcactgtattccagctggtgatcaagtctgggaacagccgtaacaggtcaaccttgtggagccatcgcgagttagagggtgaaagatggcag

SEQ ID NO: 41157 - DNA, 470 bp, Homo sapiens
  misc_feature 7: n = A,T,C or G
tcccaantgctttgattacaggggtgagccactgcacctggccttaatttttcttacctaattgcactggctagaaccttccgtacaatattgagtagaaatggcttgattgctattgtcttatttctgacattagggagaaagaaggatgaagtatgatattagctgtgggctttttatcaatgccctttctcaggtcaaggaaactcttttctactcctaatcatcaacaaatggtaccactactggataacattgtcatgaggtgtatatatgtgatatgtctaatacagtgtgatcagcatatagaaggtggtgaatatttatttcttttggctgccaacctcgaagttactgattaaaacattaaatgtgtcagaggccatcagcatgcgatttgatttctgtaggccctccatggaaaaaccattaaaaattctgttttcttttccatggggatgttgagatct

SEQ ID NO: 41158 - DNA, 343 bp, Homo sapiens
  misc_feature 29, 208: n = A,T,C or G
accgccaggctgtttcagccaggaaggcntaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcnggatctcacaggctgagaactcgttcacctccaagcatttcatgaaaaagctgcttcttattaatcatacaaactctcaccatgatgtgaagagtttcacaaatccttcaaaataaaaagtaatgacttagaaac

SEQ ID NO: 41159 - DNA, 415 bp, Homo sapiens
gatcacttggcaggggagggaggagagtgttaacagttacttcttggagaaggctctgttggggctcagtagctggcctggcctgtggagaattctagagaattccagggtgtctctaagggagggctggagcaaggccgtcttggagtagcagcagtcagatagacgatgctgccagaggctgaggaccttctctagaaaggggtgtctttgattcagtgggtgggttttaacttgtaaaataaggcaaagttgtgagatagttctctagcattaataaattcaatctgggagtggtggctcacgcctgtagtctcagcacttttggaggccgaggcgggtggatcacctgaggtcaggagtttgagaccagcctggccaacatggcaaaacatccgtctctgctgaaaagtac

SEQ ID NO: 41160 - DNA, 322 bp, Homo sapiens
gaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttt

SEQ ID NO: 41161 - DNA, 182 bp, Homo sapiens
atgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctgga

SEQ ID NO: 41162 - DNA, 477 bp, Homo sapiens
atggaaagagatttgattttccagcatgcatggagctgtctctttgttattacctgccagtgtcatgttgctgctgttttgctgtcttgtgtccatgcagatgtctcttaattatgcatttgtgttcataattttccttcctactcatgttcttattcctgcctggaacacctctagcagaaggtgaatttgactaaggtcaaatttttgcagcctttttctacttctggattttgtgtcatgcttagtaaggccttcccccactataaaattgttttttaattccaaaaaagtaaaagcgtttttgaccttgggcctgacccagatcatacttttcctggttcctgatcacctctgccataattaattttgtcttccttgtcctttttcctatatactatatgcaattatggtcatttgtataaatatcctatcattctacctaaacagaaagttctgaaggtcgacagttgcatc

SEQ ID NO: 41163 - DNA, 346 bp, Homo sapiens
aggattgacttggatgcattcttttaggctaggtctaatattggttattttgtgtaaatgatattagtagaattttaaagggtagtatgagatggtaaatgtaaaatatttgaaattaaaagttttgcacaaatgcaatgtaattattgttgcttctgttgttagtattatatacccaccataaagaccaatacatttgagaaataaaagtaaactctatgaaatttattcctggtaatcacagatagcaacaacgaaagttcacagtgaaggatatttgagagaggacattattatgaaaagctgttgatttattttgcatttttttctgtggacttaccttaca

SEQ ID NO: 41164 - DNA, 487 bp, Homo sapiens
  misc_feature 25, 36: n = A,T,C or G
cattcccttaatgtgaccttcaagnaaagattattngccagcctcctatgtttttgcatctaattttccctaaattttattggttaaaaagggtactgctacttgttactagtaaaaaccctaaattgtttggaagtgctctttaaactgatgtatggcaaagtagttaatttaagccaagtactatgtgtcatgtaggtggtcagtaaatactggtagaaacaaccactcagtaattttaaaccatgctggagagccaacaaacaactccattaaaaacgaaaagtatgtgcccctaaagaacagctatgtctgacagtatttgtgaactgtggatccaagaatagggaatgagaatggtgtatttggagagtgggagtggagctgggagaggaaaggaatgatatgggcacattccatgtcgccggcttagaggttgtggagaacctagtcatggcaagaaatagaatccattgaagacaatgta

SEQ ID NO: 41165 - DNA, 153 bp, Homo sapiens
tatttagagaaaagtaaaatagtttgaaaatagtgctatagggattttctgatactgctaaaaaatgaaggtttggcaatgagtattttttctataatatgaagatagtgctctgactctttataatcctaagttagcgccccccgccccacc

SEQ ID NO: 41166 - DNA, 475 bp, Homo sapiens
cttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttga

SEQ ID NO: 41167 - DNA, 467 bp, Homo sapiens
gatggttagtaatgattgtagtgattagaacaatggttttggggcatagtccacagtaggaaaaatgcaaaaccctacattgatttgtggggccagagagagaaaggtgccctgatgaggcagaagctcccagagagagaatggctgtaatgtaaggccagacaagtagcccacagatagataacagaaattcctagttaccagccaaccacagcaagcaatggaatgagttctgtgccttcaggtatggcagggaaccagcagagagcctgagtcatcaagcctaaatgaagctctgtggataagagtgacagccatcttgaagcctcttggatggattcaccgctagggacacagagacttcccctgcccttgtcaccccaacacttcagcaccaagtaagtcaccccaccaacataaacatagtaacaagtatggaaggtaagggagaagagatatcctgaggt

SEQ ID NO: 41168 - DNA, 386 bp, Homo sapiens
  misc_feature 297: n = A,T,C or G
atggcggtggaggccaatactttgcaaaaccacgaaaccaaggtggctatggcggttccagcagcagcagtagctatggcagtggcagaagattttaattaggaaacaaagcttagcaggagaggagagccaggagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggtnattttagtttctgttctgtggaaagtgtaaagcattccaacaaagggttttaatgtagattttttttttgcaccccatgctgttgattg

SEQ ID NO: 41169 - DNA, 387 bp, Homo sapiens
  misc_feature 7, 21, 386: n = A,T,C or G
gacagtnaagcccaaaaccgnaagacattgatgaggaagatgatgatgttccagatcttgtagaaaattttgatgaggcatcaaagaatgaagctaactaaaagtttggtttttggaagctggcatggactatgatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggng

SEQ ID NO: 41170 - DNA, 207 bp, Homo sapiens
tagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatctt

SEQ ID NO: 41171 - DNA, 359 bp, Homo sapiens
attggagatataagacatacttctcacatatttagatgacacaggttagtacattgaatatcagccagggtttttaaggatcttaatagagtggaactaaggtagaaactattaagagcaattaatagtgatatatctatagtcctgtttctaaacaagtttttttaaaaacctcaactctgactatagtgaacagagaagtcttggactcttacaattcatgtgagaagacctgaaactttgataacaattatatacattttgtgagtaatttctttggtgtatgccttcacatatctctggtatgtgacctatgctgcagtccattgagcatagattcccagaatgtattctcctac

SEQ ID NO: 41172 - DNA, 493 bp, Homo sapiens
  misc_feature 4, 10, 487: n = A,T,C or G
cccngggaantcggcctttatggccgaggttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggngggaag

SEQ ID NO: 41173 - DNA, 437 bp, Homo sapiens
agaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaag

SEQ ID NO: 41174 - DNA, 491 bp, Homo sapiens
  misc_feature 16, 24, 31, 32, 54, 57, 82, 96, 104, 128, 198, 228, 231,236, 280, 297, 315, 325, 349, 359, 384, 401, 412, 481, 489: n = A,T,C or G
gaaaatccattaggtnagcataantatgaanntttaatattctgtggtgccagngcncactaccttcccacccatacacatncatgttcactgtancaaactgnatattcacaataaagcttctgagnaacactttctgattactcatgataaactgacatggctaacttgcaagaattaaatcttctatctgagagnaataatttatgatgactcagtggtgccaanagnaaagnctctaaaataacattcctctcacttggaccccactaaaagtatnagtctacacattacatngaagttaaacacaaaatnatcagtgttntagaaacatgagtccggactgtgnaagtaaaagnacaaacattatttccaccataaagnatgtattgaaatcaagntgtctctgtgnacatgaatacatacttattcccatttttaagcatttgcttctgttttccctacctagaatgacagatgnttttcagnta

SEQ ID NO: 41175 - DNA, 369 bp, Homo sapiens
  misc_feature 157, 171, 287, 331: n = A,T,C or G
agagaaccagtcttggatctcccttctctactttgttactgaaatcttgaacctgtagaacattacttatcactgtgttcctttctaatgggaaaataataataaacacttgcagagtattttttaaaagtttttagctttaaaaaaaaaaccctgngccttacacaatgngtatattgagttgatactgattatgataattagatggtattatacaatcattcattcagcaaacattcacttactgagcaccctactaatgttccaggtactgattgttaaaaggngattgagacacagcctctgtcctgagcttagtctagtaggaggngacagatttgtaaataatagatttggaaggtgctgagc

SEQ ID NO: 41176 - DNA, 168 bp, Homo sapiens
gagtacggcaaatatggcggagccatctgttgaatcttcaagtccagaaatggatgaaaggtttgactgcccatgaaagtacaggaggttcagcaacatcagatgaccatgaatttgatccatcagctgacatgctggttcatgattttgatgatgaacgaacattag

SEQ ID NO: 41177 - DNA, 466 bp, Homo sapiens
  misc_feature 7, 34, 43: n = A,T,C or G
aacatgnagactggcgagtacttgcgtctacccnaatccagcnaacgttcccaagaaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacat

SEQ ID NO: 41178 - DNA, 101 bp, Homo sapiens
  misc_feature 12, 20, 62, 79, 83, 87: n = A,T,C or G
agagtctccagnttcaagtntcccaaagttacttaaatgaaaccttttcccctgacatccgnattttaattttattttnaatnaatngatctaaattacat

SEQ ID NO: 41179 - DNA, 458 bp, Homo sapiens
  misc_feature 4, 12, 29, 156: n = A,T,C or G
gacncgccggangaaagaggaagactacnaggctgcggaggagactgcttttgttgttgatgaagtgagcaacattgtaaaagaggctatagaaagcgcaattggtggtaacgcttatcaacacagcaaagtgaaccagtggaccacaaatgtggnagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttg

SEQ ID NO: 41180 - DNA, 133 bp, Homo sapiens
  misc_feature 132: n = A,T,C or G
catctacgtgtgagcacccaagggtaacaaccagtatggcttcactgaaacctgcttttgtaaattacttttttttactgttgctggaagtgtcccacctgctgctcataataaatgcagatgtctatgcanc

SEQ ID NO: 41181 - DNA, 466 bp, Homo sapiens
  misc_feature 33, 455: n = A,T,C or G
gaggcgagggcgccgcacccacaccgcgctgcncagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacacgggagaacccagcaagcgtagtcgaggagccctggggtccatcgccctcctgggcttggngggcacaactg

SEQ ID NO: 41182 - DNA, 475 bp, Homo sapiens
  misc_feature 7, 19: n = A,T,C or G
ctgtganttctaattaatnccgctggccattacacaggttttgttgtttggggtggggagggggcttttgttccctttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaaggtattttcattatatgaaagctaccat

SEQ ID NO: 41183 - DNA, 126 bp, Homo sapiens
gactcttagcggtggatcactcggctcgtgcgtcgatgaagaacgcagctagctgcgagaattaatgtgaattgcaggacacattgatcatcgacacttcgaacgcacttgcggccccgggttcct

SEQ ID NO: 41184 - DNA, 467 bp, Homo sapiens
  misc_feature 261, 376, 447, 459: n = A,T,C or G
agttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcatatgtatactgtaacccagtaaattttgcattcagttttaaaaaatgaagatgtaacttacctgagtctcatttttgaaaatgaaattctgcaaaaattatttaaaaattagntcttggggaaattgattttcaagattcaagtgtataaaaacttatattgaacttttcagcctcgtttttaattagctgatgttaatgataagatacataatacatgtatcttgtngctgaaaatattttttgcatttcaacacattgagttaaaataaagttgttactacttattcaagattaatnggcttatcttgngtttattt

SEQ ID NO: 41185 - DNA, 490 bp, Homo sapiens
  misc_feature 33, 211: n = A,T,C or G
caaagccctaagccttgatgactttaagggganatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggnttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagct

SEQ ID NO: 41186 - DNA, 199 bp, Homo sapiens
cattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttcc

SEQ ID NO: 41187 - DNA, 475 bp, Homo sapiens
agtgagagggcagaggaaatactcaatctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggagggaagaagaggagacttcaaatgaaggagaaaacaatgaagaatcgaatgaagatgaagactctgaggctgagaataccacactttctgctacaacactgggctatggagaggacgccacgcctggcacagggtatacaggggtt

SEQ ID NO: 41188 - DNA, 466 bp, Homo sapiens
  misc_feature 34: n = A,T,C or G
ctcacagcaacctgtggatgaatactgtattcangcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaaagatgataaaacagttttggatcttgctgtggttttgtttgaaacagcaac

SEQ ID NO: 41189 - DNA, 167 bp, Homo sapiens
  misc_feature 32: n = A,T,C or G
ctactaaaaatacaaaaaattagccggcgtgntggcacgtgcctgtagtcccagctactccggaggctgaggcaggagaatggcgtgaacccgggaggcggagcttgcagtgagctgagatggcgccactgcactccagcctaggcaacagagcaagactccgtctc

SEQ ID NO: 41190 - DNA, 466 bp, Homo sapiens
  misc_feature 6, 34: n = A,T,C or G
agggantgaagaagctctcctacatccgcattgntgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttagacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgc
